(12) United States Patent
Bradner et al.

(10) Patent No.: US 11,999,802 B2
(45) Date of Patent: Jun. 4, 2024

(54) COMPOSITIONS AND METHODS FOR SELECTIVE PROTEIN DEGRADATION

(71) Applicant: Novartis AG, Basel (CH)

(72) Inventors: James E. Bradner, Weston, MA (US); Andrei Golosov, Cambridge, MA (US); Carleton Proctor Goold, Brighton, MA (US); Carla Patricia Pinto Guimaraes, Boston, MA (US); Marc Horst Peter Hild, Wellesley, MA (US); Gregory Motz, Quincy, MA (US); Nathan Thomas Ross, Cambridge, MA (US); Jonathan M. Solomon, Somerville, MA (US); Rohan Eric John Beckwith, Maynard, MA (US); Seth Carbonneau, Roxbury, MA (US)

(73) Assignee: Novartis AG, Basel (CH)

( * ) Notice: Subject to any disclaimer, the term of this patent is extended or adjusted under 35 U.S.C. 154(b) by 605 days.

(21) Appl. No.: 16/757,026

(22) PCT Filed: Oct. 18, 2018

(86) PCT No.: PCT/US2018/056472
§ 371 (c)(1),
(2) Date: Apr. 17, 2020

(87) PCT Pub. No.: WO2019/079569
PCT Pub. Date: Apr. 25, 2019

(65) Prior Publication Data
US 2020/0339704 A1 Oct. 29, 2020

Related U.S. Application Data

(60) Provisional application No. 62/574,188, filed on Oct. 18, 2017.

(51) Int. Cl.
| | | |
|---|---|---|
| *C07K 19/00* | (2006.01) |
| *A61K 31/4545* | (2006.01) |
| *A61K 31/46* | (2006.01) |
| *A61K 35/12* | (2015.01) |
| *C07D 209/48* | (2006.01) |
| *C07D 213/81* | (2006.01) |
| *C07D 401/14* | (2006.01) |
| *C07D 451/02* | (2006.01) |
| *C07K 14/435* | (2006.01) |
| *C07K 14/705* | (2006.01) |
| *C07K 14/725* | (2006.01) |
| *C07K 16/18* | (2006.01) |
| *C07K 16/28* | (2006.01) |
| *C12N 9/06* | (2006.01) |
| *C12N 15/63* | (2006.01) |
| *C12N 15/86* | (2006.01) |
| *G01N 33/68* | (2006.01) |

(52) U.S. Cl.
CPC .......... *C07K 19/00* (2013.01); *A61K 31/4545* (2013.01); *A61K 31/46* (2013.01); *A61K 35/12* (2013.01); *C07D 209/48* (2013.01); *C07D 213/81* (2013.01); *C07D 401/14* (2013.01); *C07D 451/02* (2013.01); *C07K 14/435* (2013.01); *C07K 14/705* (2013.01); *C07K 14/7051* (2013.01); *C07K 14/70521* (2013.01); *C07K 14/70575* (2013.01); *C07K 16/18* (2013.01); *C07K 16/2803* (2013.01); *C07K 16/2815* (2013.01); *C07K 16/2863* (2013.01); *C07K 16/2875* (2013.01); *C07K 16/2887* (2013.01); *C07K 16/2896* (2013.01); *C12N 9/003* (2013.01); *C12N 15/63* (2013.01); *C12N 15/86* (2013.01); *C12Y 105/01003* (2013.01); *G01N 33/6803* (2013.01); *C07K 2317/622* (2013.01); *C07K 2319/02* (2013.01); *C07K 2319/03* (2013.01); *C07K 2319/20* (2013.01); *C07K 2319/35* (2013.01); *C07K 2319/81* (2013.01); *C07K 2319/95* (2013.01); *C12N 2740/15043* (2013.01)

(58) Field of Classification Search
None
See application file for complete search history.

(56) References Cited

U.S. PATENT DOCUMENTS

| 5,359,046 A | 10/1994 | Capon et al. |
|---|---|---|
| 5,686,281 A | 11/1997 | Roberts |
| 5,712,149 A | 1/1998 | Roberts |
| 5,874,240 A | 2/1999 | Ni et al. |
| 5,906,936 A | 5/1999 | Eshhar et al. |

(Continued)

FOREIGN PATENT DOCUMENTS

| EP | 0574512 A1 | 12/1993 |
|---|---|---|
| EP | 0871495 A1 | 10/1998 |

(Continued)

OTHER PUBLICATIONS

Chamberlain et al., Nature Structural & molecular biology 21(9): 803-810 (Year: 2014).*

(Continued)

*Primary Examiner* — Phuong Huynh
(74) *Attorney, Agent, or Firm* — K&L Gates LLP

(57) ABSTRACT

The invention provides compositions including a fusion polypeptide and methods for making a fusion polypeptide that includes a COF1/CRBN-binding polypeptide, COF2/CRBN-binding polypeptide, or COF3/CRBN-binding polypeptide and a heterologous polypeptide of interest.

33 Claims, 68 Drawing Sheets
Specification includes a Sequence Listing.

(56) References Cited

U.S. PATENT DOCUMENTS

| | | | |
|---|---|---|---|
| 6,103,521 A | 8/2000 | Capon et al. | |
| 6,319,494 B1 | 11/2001 | Capon et al. | |
| 6,355,779 B1 | 3/2002 | Goodwin et al. | |
| 6,410,319 B1 | 6/2002 | Raubitschek et al. | |
| 6,569,997 B1 | 5/2003 | Kwon | |
| 7,049,136 B2 | 5/2006 | Seed et al. | |
| 7,052,906 B1 | 5/2006 | Lawson et al. | |
| 7,070,995 B2 | 7/2006 | Jensen | |
| 7,265,209 B2 | 9/2007 | Jensen | |
| 7,319,143 B2 | 1/2008 | Gross et al. | |
| 7,320,787 B2 | 1/2008 | Seed et al. | |
| 7,446,190 B2 | 11/2008 | Sadelain et al. | |
| 7,446,191 B2 | 11/2008 | Jensen | |
| 7,514,537 B2 | 4/2009 | Jensen | |
| 7,638,326 B2 | 12/2009 | June et al. | |
| 7,741,465 B1 | 6/2010 | Eshhar et al. | |
| 7,745,140 B2 | 6/2010 | June et al. | |
| 7,754,482 B2 | 7/2010 | Riley et al. | |
| 7,994,298 B2 | 8/2011 | Zhang et al. | |
| 8,211,422 B2 | 7/2012 | Eshhar et al. | |
| 8,252,914 B2 | 8/2012 | Zhang et al. | |
| 8,389,282 B2 | 3/2013 | Sadelain et al. | |
| 8,399,645 B2 | 3/2013 | Campana et al. | |
| 8,465,743 B2 | 6/2013 | Rosenberg et al. | |
| 8,637,307 B2 | 1/2014 | June et al. | |
| 8,722,400 B2 | 5/2014 | Riley et al. | |
| 8,906,682 B2 | 12/2014 | June et al. | |
| 8,911,993 B2 | 12/2014 | June et al. | |
| 8,916,381 B1 | 12/2014 | June et al. | |
| 8,975,071 B1 | 3/2015 | June et al. | |
| 9,101,584 B2 | 8/2015 | June et al. | |
| 9,102,760 B2 | 8/2015 | June et al. | |
| 9,102,761 B2 | 8/2015 | June et al. | |
| 9,394,368 B2 | 7/2016 | Brogdon et al. | |
| 9,573,988 B2 | 2/2017 | Brogdon et al. | |
| 9,745,368 B2 | 8/2017 | Milone et al. | |
| 9,777,061 B2 | 10/2017 | Ebersbach et al. | |
| 9,815,901 B2 | 11/2017 | Brogdon et al. | |
| 10,174,095 B2 | 1/2019 | Brogdon et al. | |
| 10,683,360 B2 * | 6/2020 | Brayshaw | C07K 16/2878 |
| 2003/0060444 A1 | 3/2003 | Finney et al. | |
| 2003/0077249 A1 | 4/2003 | Bebbington et al. | |
| 2003/0147869 A1 | 8/2003 | Riley et al. | |
| 2003/0148982 A1 | 8/2003 | Brenner et al. | |
| 2003/0224520 A1 | 12/2003 | June et al. | |
| 2004/0038886 A1 | 2/2004 | Finney et al. | |
| 2004/0043401 A1 | 3/2004 | Sadelain et al. | |
| 2004/0101519 A1 | 5/2004 | June et al. | |
| 2004/0110290 A1 | 6/2004 | June et al. | |
| 2005/0113564 A1 | 5/2005 | Campana et al. | |
| 2005/0129671 A1 | 6/2005 | Cooper et al. | |
| 2006/0034810 A1 | 2/2006 | Riley et al. | |
| 2007/0036773 A1 | 2/2007 | Cooper et al. | |
| 2008/0131415 A1 | 6/2008 | Riddell et al. | |
| 2009/0215169 A1 | 8/2009 | Wandless et al. | |
| 2009/0257994 A1 | 10/2009 | Jensen | |
| 2010/0261269 A1 | 10/2010 | June et al. | |
| 2011/0052554 A1 | 3/2011 | Zakrzewski et al. | |
| 2011/0262467 A1 | 10/2011 | Riley et al. | |
| 2012/0148552 A1 | 6/2012 | Jensen | |
| 2012/0321667 A1 | 12/2012 | Sentman | |
| 2013/0071409 A1 | 3/2013 | Riley et al. | |
| 2013/0071414 A1 | 3/2013 | Dotti et al. | |
| 2013/0149337 A1 | 6/2013 | Cooper et al. | |
| 2013/0155909 A1 | 6/2013 | Jackson et al. | |
| 2013/0287748 A1 | 10/2013 | June et al. | |
| 2013/0288368 A1 | 10/2013 | June et al. | |
| 2013/0309258 A1 | 11/2013 | June et al. | |
| 2014/0050708 A1 | 2/2014 | Powell et al. | |
| 2014/0090111 A1 | 3/2014 | Frommer et al. | |
| 2014/0099309 A1 | 4/2014 | Powell, Jr. et al. | |
| 2014/0099340 A1 | 4/2014 | June et al. | |
| 2014/0106449 A1 | 4/2014 | June et al. | |
| 2014/0186947 A1 | 7/2014 | June et al. | |
| 2014/0212446 A1 | 7/2014 | Riley et al. | |
| 2014/0219975 A1 | 8/2014 | June et al. | |
| 2014/0227237 A1 | 8/2014 | June et al. | |
| 2014/0271635 A1 | 9/2014 | Brogdon et al. | |
| 2014/0322169 A1 | 10/2014 | Harper et al. | |
| 2014/0322183 A1 | 10/2014 | Milone et al. | |
| 2014/0322212 A1 | 10/2014 | Brogdon et al. | |
| 2014/0322275 A1 | 10/2014 | Brogdon et al. | |
| 2014/0370017 A1 | 12/2014 | June et al. | |
| 2014/0370045 A1 | 12/2014 | June et al. | |
| 2015/0017141 A1 | 1/2015 | June et al. | |
| 2015/0024482 A1 | 1/2015 | Frigault et al. | |
| 2015/0050729 A1 | 2/2015 | June et al. | |
| 2015/0093822 A1 | 4/2015 | June et al. | |
| 2015/0099299 A1 | 4/2015 | June et al. | |
| 2015/0118202 A1 | 4/2015 | June et al. | |
| 2015/0140019 A1 | 5/2015 | June et al. | |
| 2015/0190428 A1 | 7/2015 | June et al. | |
| 2015/0202286 A1 | 7/2015 | June et al. | |
| 2015/0283178 A1 | 10/2015 | June et al. | |
| 2015/0290244 A1 | 10/2015 | June et al. | |
| 2015/0342994 A1 | 12/2015 | Riley et al. | |
| 2016/0046724 A1 | 2/2016 | Brogdon et al. | |
| 2016/0051651 A1 | 2/2016 | Brogdon et al. | |
| 2016/0068601 A1 | 3/2016 | Brogdon et al. | |
| 2016/0096892 A1 | 4/2016 | Brogdon et al. | |
| 2016/0185861 A1 | 6/2016 | Bedoya et al. | |
| 2016/0282354 A1 * | 9/2016 | Ebert | G01N 33/5011 |
| 2016/0311907 A1 | 10/2016 | Brogdon et al. | |
| 2016/0311917 A1 | 10/2016 | Beatty et al. | |
| 2016/0340406 A1 | 11/2016 | Zhao et al. | |
| 2016/0362472 A1 | 12/2016 | Bitter et al. | |
| 2017/0008963 A1 | 1/2017 | Brogdon et al. | |
| 2017/0081411 A1 | 3/2017 | Engels et al. | |
| 2017/0137783 A1 | 5/2017 | Bedoya et al. | |
| 2017/0183415 A1 | 6/2017 | Brogdon et al. | |
| 2017/0209492 A1 | 7/2017 | June et al. | |
| 2017/0211055 A1 | 7/2017 | Brogdon et al. | |
| 2017/0226495 A1 | 8/2017 | Guimaraes | |
| 2017/0239294 A1 | 8/2017 | Thomas-Tikhonenko et al. | |
| 2017/0260268 A1 | 9/2017 | Beatty et al. | |
| 2017/0274014 A1 | 9/2017 | Brogdon et al. | |
| 2017/0306416 A1 | 10/2017 | Bedoya et al. | |
| 2017/0335281 A1 | 11/2017 | Loew et al. | |
| 2018/0022795 A1 | 1/2018 | Milone et al. | |
| 2018/0044423 A1 | 2/2018 | Ebersbach et al. | |
| 2018/0044424 A1 | 2/2018 | June et al. | |
| 2018/0118834 A1 | 5/2018 | Brogdon et al. | |
| 2018/0125892 A1 | 5/2018 | Brannetti et al. | |
| 2018/0133296 A1 | 5/2018 | Barrett et al. | |
| 2018/0140602 A1 | 5/2018 | Angst et al. | |
| 2018/0230193 A1 | 8/2018 | Loew et al. | |
| 2018/0252727 A1 | 9/2018 | Garfall et al. | |
| 2018/0258149 A1 | 9/2018 | Motz et al. | |
| 2018/0298068 A1 | 10/2018 | Albelda | |
| 2018/0312595 A1 | 11/2018 | Brogdon et al. | |
| 2019/0000880 A1 | 1/2019 | Motz et al. | |
| 2019/0000944 A1 | 1/2019 | Brogdon et al. | |
| 2019/0135940 A1 | 5/2019 | Brogdon et al. | |
| 2019/0151365 A1 | 5/2019 | Anak et al. | |
| 2019/0153061 A1 | 5/2019 | Brogdon et al. | |
| 2019/0161542 A1 | 5/2019 | Gill et al. | |
| 2019/0263914 A1 | 8/2019 | Brogdon et al. | |
| 2019/0269727 A1 | 9/2019 | Fachin et al. | |
| 2019/0292238 A1 | 9/2019 | Bitter et al. | |
| 2019/0292257 A1 | 9/2019 | Bedoya et al. | |
| 2019/0298715 A1 | 10/2019 | Motz et al. | |
| 2019/0330356 A1 | 10/2019 | Brogdon et al. | |
| 2019/0336504 A1 | 11/2019 | Gill et al. | |
| 2019/0375815 A1 | 12/2019 | Engels et al. | |
| 2019/0382500 A1 | 12/2019 | Abujoub et al. | |
| 2019/0388471 A1 | 12/2019 | June et al. | |
| 2019/0389928 A1 | 12/2019 | Posey et al. | |
| 2020/0048359 A1 | 2/2020 | Albelda et al. | |
| 2020/0055948 A1 | 2/2020 | Daley et al. | |
| 2020/0061113 A1 | 2/2020 | Kassim et al. | |
| 2020/0085869 A1 | 3/2020 | Schuster et al. | |
| 2020/0087376 A1 | 3/2020 | Fraietta et al. | |
| 2020/0113941 A1 | 4/2020 | Brannetti et al. | |
| 2020/0179511 A1 | 6/2020 | Daley et al. | |

(56) References Cited

U.S. PATENT DOCUMENTS

| | | | |
|---|---|---|---|
| 2020/0215171 A1 | 7/2020 | Brogdon et al. |
| 2020/0281973 A1 | 9/2020 | Dranoff |
| 2020/0283729 A1 | 9/2020 | Loew et al. |
| 2020/0291354 A1 | 9/2020 | Johnson et al. |
| 2020/0339704 A1 | 10/2020 | Bradner et al. |
| 2020/0360431 A1 | 11/2020 | Garfall et al. |
| 2020/0370012 A1 | 11/2020 | Fraietta et al. |
| 2020/0371091 A1 | 11/2020 | Pruteanu-Malinici et al. |
| 2020/0399383 A1 | 12/2020 | Scholler et al. |
| 2021/0002377 A1 | 1/2021 | Brogdon et al. |
| 2021/0047405 A1 | 2/2021 | Nobles et al. |
| 2021/0079073 A1 | 3/2021 | Milone et al. |
| 2021/0087279 A1 | 3/2021 | Engels et al. |
| 2021/0139595 A1 | 5/2021 | Ebersbach et al. |
| 2021/0171909 A1 | 6/2021 | Golovina et al. |
| 2021/0172020 A1 | 6/2021 | Bedoya et al. |
| 2021/0177896 A1 | 6/2021 | Porter et al. |
| 2021/0177900 A1 | 6/2021 | Engels et al. |
| 2021/0213063 A1 | 7/2021 | Isaacs et al. |
| 2021/0214459 A1 | 7/2021 | Brock et al. |
| 2021/0220404 A1 | 7/2021 | Abujoub et al. |
| 2021/0246423 A1 | 8/2021 | Bedoya et al. |
| 2021/0284752 A1 | 9/2021 | Brogdon et al. |
| 2021/0317183 A1 | 10/2021 | Zhao et al. |
| 2021/0347851 A1 | 11/2021 | Isaacs et al. |
| 2021/0396739 A1 | 12/2021 | Pruteanu-Malinici et al. |
| 2022/0047633 A1 | 2/2022 | Grupp |
| 2022/0064316 A1 | 3/2022 | Brogdon et al. |
| 2022/0089750 A1 | 3/2022 | June et al. |
| 2022/0152150 A1 | 5/2022 | Koshy et al. |
| 2022/0168389 A1 | 6/2022 | Ghassemi et al. |
| 2022/0195010 A1 | 6/2022 | Bitter et al. |
| 2022/0251152 A1 | 8/2022 | Carbonneau et al. |
| 2022/0364055 A1 | 11/2022 | Treanor et al. |
| 2022/0387486 A1 | 12/2022 | Brannetti et al. |
| 2023/0026049 A1 | 1/2023 | Brogdon et al. |
| 2023/0071283 A1 | 3/2023 | Golosov et al. |
| 2023/0074800 A1 | 3/2023 | Berger et al. |
| 2023/0111593 A1 | 4/2023 | Schuster et al. |
| 2023/0139800 A1 | 5/2023 | Motz et al. |
| 2023/0174933 A1 | 6/2023 | Brogdon et al. |
| 2023/0183368 A1 | 6/2023 | Abujoub et al. |
| 2023/0220090 A1 | 7/2023 | Brogdon et al. |
| 2023/0250179 A1 | 8/2023 | Abujoub et al. |
| 2023/0256017 A1 | 8/2023 | Brogdon et al. |
| 2023/0295296 A1 | 9/2023 | Bedoya et al. |
| 2023/0302155 A1 | 9/2023 | Koshy et al. |
| 2023/0312677 A1 | 10/2023 | Posey et al. |
| 2023/0332104 A1 | 10/2023 | Estevez Silva et al. |
| 2023/0357717 A1 | 11/2023 | Johnson et al. |
| 2023/0374105 A1 | 11/2023 | Bitter et al. |

FOREIGN PATENT DOCUMENTS

| | | | | |
|---|---|---|---|---|
| EP | 1226244 A2 | 7/2002 | | |
| WO | 1992015322 A1 | 9/1992 | | |
| WO | 199530014 A1 | 11/1995 | | |
| WO | 9623814 A1 | 8/1996 | | |
| WO | 9624671 A1 | 8/1996 | | |
| WO | 1997015669 A1 | 5/1997 | | |
| WO | 9723613 A2 | 7/1997 | | |
| WO | 9818809 A1 | 5/1998 | | |
| WO | 9900494 A2 | 1/1999 | | |
| WO | 9957268 A1 | 11/1999 | | |
| WO | 0014257 A1 | 3/2000 | | |
| WO | 2000/023602 A2 | 4/2000 | | |
| WO | WO-0023602 A2 * | 4/2000 | ............ | C07K 14/47 |
| WO | 2001/057242 A2 | 8/2001 | | |
| WO | 2002033101 A1 | 4/2002 | | |
| WO | 02077029 A2 | 10/2002 | | |
| WO | 02088334 A1 | 11/2002 | | |
| WO | 2003057171 A2 | 7/2003 | | |
| WO | 2005019429 A2 | 3/2005 | | |
| WO | 2005044996 A2 | 5/2005 | | |
| WO | 2005/118788 A2 | 12/2005 | | |
| WO | 2006060878 A1 | 6/2006 | | |
| WO | 2008045437 A2 | 4/2008 | | |
| WO | 2009091826 A2 | 7/2009 | | |
| WO | 2010085660 A2 | 7/2010 | | |
| WO | 2011049043 A1 | 4/2011 | | |
| WO | 2011059836 A2 | 5/2011 | | |
| WO | 2011097477 A1 | 8/2011 | | |
| WO | 2012058460 A2 | 5/2012 | | |
| WO | 2012079000 A1 | 6/2012 | | |
| WO | 2012082841 A2 | 6/2012 | | |
| WO | 2012/099973 A2 | 7/2012 | | |
| WO | 2012127464 A2 | 9/2012 | | |
| WO | 2012129514 A1 | 9/2012 | | |
| WO | 2012135854 A2 | 10/2012 | | |
| WO | 2012138858 A1 | 10/2012 | | |
| WO | 2013019615 A2 | 2/2013 | | |
| WO | 2013033626 A2 | 3/2013 | | |
| WO | 2013040371 A2 | 3/2013 | | |
| WO | 2013040557 A2 | 3/2013 | | |
| WO | 2013059593 A1 | 4/2013 | | |
| WO | 2013/126712 A1 | 8/2013 | | |
| WO | 2013126729 A1 | 8/2013 | | |
| WO | 2013126733 A1 | 8/2013 | | |
| WO | 2014/011984 A1 | 1/2014 | | |
| WO | 2014/011987 A1 | 1/2014 | | |
| WO | 2014/011993 A2 | 1/2014 | | |
| WO | 2014/012001 A2 | 1/2014 | | |
| WO | 2014011988 A2 | 1/2014 | | |
| WO | 2014011996 A1 | 1/2014 | | |
| WO | WO-2014004990 A2 * | 1/2014 | ......... | G01N 33/5023 |
| WO | 2014031687 A1 | 2/2014 | | |
| WO | 2014039513 A2 | 3/2014 | | |
| WO | 2014/055442 A2 | 4/2014 | | |
| WO | 2014055657 A1 | 4/2014 | | |
| WO | 2014130635 A1 | 8/2014 | | |
| WO | 2014/145252 A2 | 9/2014 | | |
| WO | 2014190273 A1 | 11/2014 | | |
| WO | WO-2015077058 A2 * | 5/2015 | ......... | A01K 67/0278 |
| WO | 2015090229 A1 | 6/2015 | | |
| WO | 2015090230 A1 | 6/2015 | | |
| WO | 2015112626 A1 | 7/2015 | | |
| WO | 2015127351 A1 | 8/2015 | | |
| WO | 2015/134877 A1 | 9/2015 | | |
| WO | 2015/142661 A1 | 9/2015 | | |
| WO | 2015142675 A2 | 9/2015 | | |
| WO | 2015157252 A1 | 10/2015 | | |
| WO | 2015/168613 A2 | 11/2015 | | |
| WO | 2016014501 A1 | 1/2016 | | |
| WO | 2016014530 A1 | 1/2016 | | |
| WO | 2016014535 A1 | 1/2016 | | |
| WO | 2016014553 A1 | 1/2016 | | |
| WO | 2016014565 A2 | 1/2016 | | |
| WO | 2016014576 A1 | 1/2016 | | |
| WO | 2016019300 A1 | 2/2016 | | |
| WO | 2016025880 A1 | 2/2016 | | |
| WO | 2016028896 A1 | 2/2016 | | |
| WO | 2016044605 A1 | 3/2016 | | |
| WO | WO-2016057897 A1 * | 4/2016 | ......... | C12N 15/1082 |
| WO | 2016106244 A1 | 6/2016 | | |
| WO | 2017004022 A2 | 1/2017 | | |
| WO | 2017/024318 A1 | 2/2017 | | |
| WO | 2017032777 A1 | 3/2017 | | |
| WO | 2017044801 A2 | 3/2017 | | |
| WO | 2017/181119 A2 | 10/2017 | | |
| WO | 2018053006 A1 | 3/2018 | | |
| WO | 2018075820 A1 | 4/2018 | | |
| WO | 2018148440 A1 | 8/2018 | | |
| WO | 2018148443 A1 | 8/2018 | | |
| WO | 2019007869 A1 | 1/2019 | | |
| WO | 2019079569 A1 | 4/2019 | | |

OTHER PUBLICATIONS

Shi et al., Blood 124(21): 2247 (Year: 2014).*
Miyazaki et al., J American Chemical Society 134: 3942-3945 (Year: 2012).*
Mori et al., Scientific Reports 8: 1294 (Year: 2018).*

(56) References Cited

OTHER PUBLICATIONS

Guedan et al., "Engineering and Design of Chimeric Antigen Receptors" Molecular Therapy Methods & Clinical Development; vol. 12: 145-156 (Year: 2019).*
Baeksgaard & Sorensen, "Acute tumor lysis syndrome in solid tumors—a case report and review of the literature" Cancer Chemotherapy Pharmacology (2003) vol. 51 pp. 187-192.
Bondanza et al. "Suicide gene therapy of graft-versus-host disease induced by central memory human T lymphocytes" Blood (2006) vol. 107 No. 5 pp. 1828-1836.
Brentjens et al. "Genetically Targeted T Cells Eradicate Systemic Acute Lymphoblastic Leukemia Xenografts", Clinical Cancer Research(2007) vol. 13, No. 18, pp. 5426-5435.
Brentjens et al. "Treatment of Chronic Lymphocytic Leukemia With Genetically Targeted Autologous T Cells: Case Report of an Unforeseen Adverse Event in a Phase I Clinical Trial" The American Society of Gene Therapy (2010) vol. 18 No. 4 pp. 666-668.
Brentjens et al., "A Phase I Trial for the Treatment of chemo-Refractory Chronic Lymphocytic Leukemia with CD19-Targeted Autologous T Cells" Molecular Therapy (2008) vol. 16 Suppl 1 p. S15.
Brentjens et al., "CD19-Targeted T Cells Rapidly Induce Molecular Remissions in Adults with Chemotherapy-Refractory Acute Lymphoblastic Leukemia," Sci. Transl. Med. 5:177ra138 (2013).
Brentjens et al., "Eradication of systemic B-cell tumors by genetically targeted human T lymphocytes co-stimulated by CD80 and interleukin-15" Nature Medicine (2003) vol. 9 No. 3 pp. 279-286.
Brentjens et al., "Safety and persistence of adoptively transferred autologous CD19-targeted T cells in patients with relapsed or chemotherapy refractory B-cell leukemias" Blood (2011) vol. 118 No. 18 pp. 4817-4828.
Brocker and Karjalainen, "Signals through T Cell Receptor-Chain alone are Insufficient to Prime Resting T Lymphocytes" J. Exp. Med. (1995) vol. 181 pp. 1653-1659.
Budde et al. "Combining a CD20 Chimeric Antigen Receptor and an Inducible Caspase 9 Suicide Switch to Improve the Efficacy and Safety of T Cell Adoptive Immunotherapy for Lymphoma" PLOS One (2013) vol. 8, No. 12, eB2742, pp. 1-10.
Call & Wucherpfennig, "The T Cell Receptor: Critical Role of the Membrane Environment in Receptor Assembly and Function" Annu. Rev. Immunol. (2005) vol. 23 pp. 101-125.
Carpenito et al. "Control of large, established tumor xenografts with genetically retargeted human T cells containing CD28 and CD137 domains", Proc Natl Acad Sci USA (2009) vol. 106 pp. 3360-3365.
Chung et al. "Tunable and reversible drug control of protein production via a self-excising degron" Nature Chemical Biology (2015) vol. 11, pp. 713-720.
Davila et al. "B Cell Aplasia in a Patient with Relapsed B Cell Acute Lymphoblastic Leukemia Following Re-Induction and Consolidation with Autologous T Cells Genetically Targeted to the CD19 Antigen" 53rd ASH Annual Meeting and Exposition (2010) Oral and Poster Abstract.
Di Stasi et al. "Inducible Apoptosis as a Safety Switch for Adoptive Cell Therapy" The New England Journal of Medicine (2011) vol. 365, pp. 1673-1683.
Dohner et al., "p53 Gene Deletion Predicts for Poor Survival and Non-Response to Therapy With Purine Analogs in Chronic B-Cell Leukemias" Blood (1995) vol. 85 No. 6 pp. 1580-1589.
Dropulic and June, "Gene-Based Immunotherapy for Human Immunodeficiency Virus Infection and Acquired Immunodeficiency Syndrome" Human Gene Therapy (2006) vol. 17 pp. 577-588.
Dull et al., "A Third-Generation Lentivirus Vector with a Conditional Packaging System" Journal of Virology (1998) vol. 72 No. 11 pp. 8463-8471.
Eshhar et al., "Specific activation and targeting of cytotoxic lymphocytes through chimeric single chains consisting of antibody-binding domains and the gamma or zeta subunits of the immunoglobulin and T-cell receptors," PNAS USA 90: 720-724 (1993).
Finney et al., "Activation of resting human primary T cells with chimeric receptors: costimulation from CD28, inducible costimulator, CD134, and CD137 (4-1BB) in series with signals from the TCR zeta chain," J. Immunol. 172: 104-113 (2004).
Finney et al., "Chimeric receptors providing both primary and costimulatory signaling in T cells from a single gene product," J. Immunol. 161: 2791-2797 (1998).
Frey, N. "Genetically Engineered Lymphocyte Therapy in Treating Patients With B-Cell Leukemia or Lymphoma That is Resistant or Refractory to Chemotherapy" (2015) Clinical Trial NCT01029366.
Friedmann-Morvinski et al., "Redirected primary T cells harboring a chimeric receptor require costimulation for their antigen-specific activation," Blood 105: 3087-3093 (2005).
Geiger & Jyothi, "Development and Application of Receptor-Modified T Lymphocytes for Adoptive Immunotherapy" Transfusion Medicine Reviews (2001) vol. 15 No. 1 pp. 21-34.
Geiger et al., "Integrated src kinase and constimulatory activity enhances signal transduction through single-chain chimeric receptors in T lymphocytes," Blood 98(8): 2364-2371 (2001).
GenBank Accession No. NP_000725.1 accessed on Jan. 7, 2016 from http://www.ncbi.nlm.nih.gov/protein/NP_000725.
GenBank Accession No. NP_932170.1 accessed Jan. 7, 2016 from http://www.ncbi.nlm.nih.gov/protein/NP_932170.
Ghorashian et al. "CD19 chimeric antigen receptor T cell therapy for haematological malignancies" British Journal of Haematology (2015) vol. 169, pp. 463-478.
Gilham et al., "Primary Polyclonal Human T Lymphocytes Targeted to Carcino-Embryonic Antigens and Neural Cell Adhesion Molecule Tumor Antigens by CD3-Based Chimeric Immune Receptors" Journal of Immunotherapy (2002) vol. 25 No. 2 pp. 139-151.
Gong et al. "Cancer Patient T Cells Genetically Targeted to Prostate-Specific Membrane Antigen Specifically Lyse Prostate Cancer Cells and Release Cytokines in Response to Prostate-Specific Membrane Antigen" Neoplasia (1999) vol. 1 No. 2 pp. 123-127.
Gribben et al., "Stem cell transplantation for indolent lymphoma and chronic lymphocytic leukemia" Biol Blood Marrow Transplant (2011) vol. 17 (1 Suppl): S63-S70.
Griffin, "Development and applications of surface-linked single chain antibodies against T-cell antigens" Journal of Immunological Methods (2001) vol. 248 pp. 77-90.
Gross et al., "Endowing T cells with antibody specificity using chimeric T cell receptors," The FASEB Journal 6: 3370-3378 (1992).
Grupp et al. "Chimeric Antigen Receptor-Modified T Cells for Acute Lymphoid Leukemia", New England Journal of Medicine (2013) vol. 368 No. 16 pp. 1509-1518.
Hallek et al., "Guidelines for the diagnosis and treatment of chronic lymphocytic leukemia: a report from the International Workshop on Chronic Lymphocytic Leukemia updating the National Cancer Institute Working Group 1996 guidelines" Blood (2008) vol. 111 No. 12 pp. 5446-5456.
Hekele et al., "Growth Retardation of Tumors by Adoptive Transfer of Cytotoxic T Lymphocytes Reprogrammed by CD44V6-Specific SCFV:~-Chimera" Int J. Cancer (1996) vol. 68 pp. 232-238.
Ho et al., "Adoptive immunotherapy: Engineering T cell responses as biological weapons for tumor mass destruction" Cancer Cell (2003) vol. 3 pp. 431-437.
Hollyman et al. "Manufacturing validation of biologically functional T cells targeted to CD19 antigen for autologous adoptive cell therapy" J Immunother (2009) vol. 32 No. 2 pp. 169-180.
Homback et al., "The Recombinant T Cell Receptor Strategy: Insights into Structure and Function of Recombinant Immunoreceptors on the Way Towards an Optimal Receptor Design for Cellular Immunotherapy," Current Gene Therapy 2: 211-226 (2002).
Imai et al., "Chimeric receptors with 4-1BB signaling capacity provoke potent cytotoxicity against acute lymphoblastic leukemia," Leukemia 18: 676-684 (2004).
Imai et al., "Genetic modification of primary natural killer cells overcomes inhibitory signals and induces specific killing of leukemic cells" Blood (2005) vol. 106 No. 1 pp. 376-383.
International Search Report and Written Opinion for International Application No. PCT/US2017/027778 dated Dec. 4, 2017.
International Search Report and Written Opinion for International Application No. PCT/US2018/056472 dated Apr. 9, 2019.

(56) References Cited

OTHER PUBLICATIONS

International Search Report from PCT/US2011/064191 dated Jan. 5, 2012.
Irving et al., "The cytoplasmic domain of the T cell receptor zeta chain is sufficient to couple to receptor-associated signal transduction pathways," Cell 64: 891-901 (1991).
Jena, Bipulendu et al. "Redirecting T-cell specificity by introducing a tumor-specific chimeric antigen receptor, Blood, May 3, 2010", vol. 116, No. 7, pp. 1035-1044.
Jensen et al. "Design and implementation of adoptive therapy with chimeric antigen receptor-modified T cells" Immunological Reviews (2014) vol. 257, pp. 127-144.
Jensen et al., "Anti-Transgene Rejection Responses Contribute to Attenuated Persistence of Adoptively Transferred CD20/CD19-Specific Chimeric Antigen Receptor Re-directed T Cells in Humans" Biol Blood Marrow Transplant (2010) vol. 16 No. 9 pp. 1245-1256.
Johnson et al., "Gene therapy with human and mouse T-cell receptors mediates cancer regression and targets normal tissues expressing cognate antigen" Blood (2009) vol. 114 No. 3 pp. 535-545.
June et al., "Engineering lymphocyte subsets: tools, trials and tribulations" Nat Rev Immunol (2009) vol. 9 No. 10 pp. 704-716.
Chmielewski et al., "Antigen-specific T-cell activation independently of the MHC: chimeric antigen receptor-redirected T cells," Frontiers in Immunology (2031) vol. 4, Article 371, 7 pages.
Bonger et al., "Small molecule displacement of a cryptic degron causes conditional protein degradation," Nat Chem Biol (2011) vol. 7, No. 8, pp. 531-537.
Bridgeman et al., "The Optimal Antigen Response of Chimeric Antigen Receptors Harboring the CD3 zeta Transmembrane Domain is Dependent upon Incorporation of the Receptor into the Endogenous TCR/CD3 Complex," J Immunol (2010) vol. 184, pp. 6938-6949.
Colman "Effects of amino acid sequence changes on antibody-antigen interactions" Research in Immunology (1994) vol. 145, No. 1, pp. 33-36.
De Felipe, "Polycistronic Viral Vectors," Current Gene Therapy (202) vol. 2, pp. 355-378.
Nayak et al., "Progress and Prospects: Immune Responses to Viral Vectors," Gene Ther (2010) vol. 17, No. 3, pp. 295-304.
Pakula et al., "Genetic analysis of protein stability and function," Annual Review of Genetics (1989) vol. 23, No. 1, pp. 289-310.
Safdari et al.,"Antibody humanization methods—a review and update," Biotechnology and Genetic Engineering Reviews (2013) vol. 29, No. 2, pp. 175-186.
Stevenson et al., "HIV-1 replication is controlled at the level of T cell activation and proviral integration," The EMBO Journal (1990) vol. 9, No. 5, pp. 1551-1560.
Teplyakov et al., "Antibody modeling assessment II. Structures and models," Proteins (2014) vol. 82, No. 8, pp. 1563-1582.
Tian et al., "Computational prediction of furin cleavage sites by a hybrid method and understanding mechanism underlying diseases," Sci Rep (2012) vol. 2, Article 261, 7 pages.
Zhao et al., "A Herceptin-Based Chimeric Antigen Receptor with Modified Signaling Domains Leads to Enhanced Survival of Transduced T Lymphocytes and Antitumor Activity," J Immunol (2009) vol. 183, No. 9, pp. 5563-5574.
Burns et al., "A high molecular weight-melanoma associated antigen-specific chimeric antigen receptor redirects lymphocytes to target human melanomas," Cancer Res (2010) vol. 70, No. 8, pp. 3027-3033.
Chen et al., "Fusion Protein Linkers: Property, Design and Functionality," Adv Drug Deliv Rev (2013) vol. 65, No. 10, pp. 1357-1369.
Cordoba et al., "The large ectodomains of CD45 and CD148 regulate their segregation from and inhibition of ligated T-cell receptor," Blood (2013) vol. 121, No. 21, pp. 4295-4302.
Gasser et al., "Antibody production with yeasts and filamentous fungi: on the road to large scale?" Biotechnol Lett (2007) vol. 29, pp. 201-212.
Maeda et al., "Engineering of Function Chimeric Protein G-Vargula Luciferase," Analytical Biochemistry (1997) vol. 249, pp. 147-152.
Muller et al., "Spliceosomal Peptide P140 for Immunotherapy of Systemic Lupus Erythematosus," Arthritis & Rheumatism (2008) vol. 58, No. 12, pp. 3873-3883.
Szatrowski et al., "Lineage Specific Treatment of Adult Patients with Acute Lymphoblastic Leukemia in First Remission with Anti-B4-Blocked Ricin or High-Dose Cytarabine," Cancer (2003) vol. 97, No. 6, pp. 1471-1480.
Rosano et al.: "Recombinant protein expression in *Escherichia coli*: advances and challenges," Frontiers in Microbiology (2014) vol. 5, Article 172, 17 pages.
Zhang et al., "Down-regulation of TET2 in CD3+ and CD34+ cells of myelodysplastic syndromes and enhances CD34+ cells proliferation," International Journal of Clinical and Experimental Pathology (2015) vol. 8, No. 9, pp. 10840-10846.
Kelly Moran-Crusio et al., "Tet2 Loss Leads to Increased Hematopoietic Stem Cell Self-Renewal and Myeloid Transformation," Cancer Cel (2011), vol. 20, pp. 11-24.
Scourzic et al., "TET proteins and the control of cytosine demethylation in cancer," Genome Med, Biomed Central Ltd, London, UK, (2015), vol. 7, Article 9, 16 pages.
Wu et al., "Suppression of TET1-Dependent DNA Demethylation is Essential for KRAS-Mediated Transformation," Cell Reports (2014), vol. 9, pp. 1827-1840.
Otáhal et al., "Lenalidomide enhances antitumor functions of chimeric antigen receptor modified T cells," Oncoimmunology (2016) vol. 5, No. 4, Article e1115940, 10 pages.
Kadagidze Z.G. et al., "Lymphocyte Receptors That Regulate the Immune Response—The Key to the Management of Antitumor Immunity," Voprosy Okrologii, 2015, V. 61, N. 4, p. 523-529, whole text.
Extended European Search Report for European Application No. 18808556.7, dated May 9, 2022, 13 pages.
Sun et al. "The quest for spatio-temporal control of CAR T cells" Cell Research (2015) vol. 25, pp. 1281-1282.
Till et al., "Adoptive immunotherapy for indolent non-Hodgkin lymphoma and mantle cell lymphoma using genetically modified autologous CD20-specific T cells" Blood (2008) vol. 112 No. 6 pp. 2261-2271.
Uckun et al., "Detailed studies on expression and function of CD19 surface determinant by using B43 monoclonal antibody and the clinical potential of anti-CD19 immunotoxins" Blood (1988) vol. 71 pp. 13-29.
Vinay & Kwon, "Role of 4-1BB in immune responses" Immunology (1998) vol. 10 pp. 481-489.
Willemsen et al., "Genetic Engineering of T Cell Specificity for Immunotherapy of Cancer" Human Immunology (2003) vol. 64 pp. 56-68.
Zhao et al., "A Herceptin-Based Chimeric Antigen Receptor with Modified Signaling Domains Leads to Enhanced Survival of Transduced T Lymphocytes and Antitumor Activity" The Journal of Immunology (2009) vol. 183 pp. 5563-5574.
Zufferey et al., "Multiply attenuated lentiviral vector achieves efficient gene delivery in vivo" Nature Biotechnology (1997) vol. 15 pp. 871-876.
Brentjens et al. "Novel cellular therapies for leukemia: CAR-modified T cells targeted to the CD19 antigen" Hematology (2012) pp. 143-151.
GenBank Accession ID No. OAF38847.1, retrieved from ncbi.nlm.nih.gov/protein/OAF38847.1 on Mar. 24, 2023, 2 pages.
Guedan et al., "Engineering and Design of Chimeric Antigen Receptors," Mol Therapy Methods & Clinical Development (2019) vol. 12, pp. 145-156.
Holstein et al., "Immunomodulatory drugs in multiple myeloma:mechanisms of action and clinical experience," Drugs (2017) vol. 77, No. 5, pp. 505-520.
International Search Report and Written Opinion issued in PCT/US2020/029611, dated Sep. 9, 2020, 18 pages.
Koduri et al., "Peptic degron for IMID-induced degradation of heterologous proteins," PNAS (2019) vol. 116, No. 7, pp. 2539-2544.

(56) References Cited

OTHER PUBLICATIONS

Moran-Crusio et al., "Tet2 Loss Leads to Increased Hematopoietic Stem Cell Self-Renewal and Myeloid Transformation," Cancer Cell (2011), vol. 20, pp. 11-24.
Sievers et al., "Defining the human C2H2 zinc finger degrome targeted by thalidomide analogs through CRBN," Science (2018) vol. 362, 36 pages.
Extended European Search Report issued in European Patent Application No. 23151319.3, dated Aug. 8, 2023, 11 pages.
Plaimauer et al, "'SHED' furin: mapping of the cleavage determinants and identification of its C-terminus," Biochem J (2001) vol. 354, pp. 689-695.
Kadagidze et al. "Lymphocyte Receptors that Regulate the Immune Response—the Key to the Management of Antitumor Immunity" Voprosy Okrologii (2015) vol. 61, No. 4, pp. 523-529.
Kalos et al. "T Cells with Chimeric Antigen Receptors Have Potent Antitumor Effects and Can Establish Memory in Patients with Advanced Leukemia", Science Translation Medicine (2011) vol. 3 No. 95 95ra73.
Kaykas et al. "Mutant Frizzled 4 associated with vitreoretinopathy traps wild-type Frizzled in the endoplasmic reticulum by oligomerization" Nature Cell Biology (2004) vol. 6, No. 1, pp. 52-58.
Kershaw et al., "A Phase I Study on Adoptive Immunotherapy Using Gene-Modified T Cells for Ovarian Cancer," Clin. Cancer Res. 12(20 Pt 1): 6106-6115 (2006).
Kim et al., "Human 4-1BB regulates CD28 co-stimulation to promote Th1 cell responses" Eur. J. Immunol. (1998) vol. 28 pp. 881-890.
Kochenderfer et al, "A Phase I Clinical Trial of Treatment of B-Cell Malignancies with Autologous Anti-Cd19-CAR-Transduced T Cells" Blood (2010) vol. 116 No. 21 pp. 1179-1180 & 52nd Annual Meeting of the American-Society-of-Hematology (ASH); Orlando, FL, USA; Dec. 4-7, 2010 abstract.
Kochenderfer et al. "Construction and Pre-clinical Evaluation of an Anti-CD19 Chimeric Antigen Receptor", J Immunother (2009) vol. 32, No. 7, pp. 689-702.
Kochenderfer et al., "Eradication of B-lineage cells and regression of lymphoma in a patient treated with autologous T cells genetically-engineered to recognize CD19," Blood 116: 4099-4102 (2010).
Kraus et al., "Antigen-dependent CD28 Signaling Selectively Enhances Survival and Proliferation in Genetically Modified Activated Human Primary T Lymphocytes" J. Exp. Med. (1998) vol. 188 Np 4 pp. 619-626.
Kwon et al., "cDNA sequences of two inducible T-cell genes". Proc. Natl. Acad. Sci. U.S.A. 86(6): 1963-1967 (1989).
Lamanna et al., "Pentostatin, Cyclophosphamide, and Rutuximab is an Active, Well-Tolerated Regimen for Patients With Previously Treated Chronic Lymphocytic Leukemia" Journal of Clinical Oncology (2008) vol. 24 No. 10 pp. 1575-1581.
Lamers et al., "Treatment of Metastatic Renal Cell Carcinoma With Autologous T-Lymphocytes Genetically Retargeted Against Carbonic Anhydrase IX: First Clinical Experience," J. Clin. Oncol. 24(13): e20-e22 (2006).
Laport et al., "Adoptive transfer of costimulated T cells induces lymphocytosis in patients with relapsed/refractory non-Hodgkin lymphoma following CD34+-selected hematopoietic cell transplantation" Blood (2003) vol. 102 No. 6 pp. 2004-2013.
Lee et al., "In vivo Inhibition of Human CD19-Targeted Effector T Cells by Natural T Regulatory Cells in a Xenotransplant Murine Model of B Cell Malignancy" Cancer Research (2011) vol. 71 No. 8 pp. 2871-2881.
Lee et al., "The Future is Now: Chimeric Antigen Receptors as New Targeted Therapies for Childhood Cancer," Clin. Cancer Res. 18: 2780-2790 (2012).
Letourneur et al., "T-cell and basophil activation through the cytoplasmic tail of T-cell-receptor zeta family proteins," Proc. Natl. Acad. Sci. U.S.A 88: 8905-8909 (1991).
Levine et al., "Gene transfer in humans using a conditionally replicating lentiviral vector" PNAS (2006) vol. 103 No. 46 pp. 17372-17377.
Lu et al. "The Myeloma Drug Lenalidomide Promotes the Celebron-Dependent Destruction of Ikaros Proteins" Science (2014) vol. 343, pp. 305-309.
MacAllan et al., "Measurement and modeling of human T cell kinetics" European Journal of Immunology (2003) vol. 33 pp. 2316-2326.
Maher et al., "Human T lymphocyte cytotoxicity and proliferation directed by a single chimeric TCRzeta/CD28 receptor," Nat. Biotechnol. 20: 70-75 (2002).
McGuinness et al., "Anti-tumor activity of human T cells expressing the CC49-zeta chimeric immune receptor," Hum. Gene Ther. 10: 165-173 (1999).
Milone et al, "Chimeric Receptors Containing CD137 Signal Transduction Domains Mediate Enhanced Survival of T Cells and Increased Antileukemic Efficacy In Vivo" Molecular Therapy (2009) vol. 17 No. 8 pp. 1453-1464.
Miyazaki et al. "Destabilizing Domains Derived from the Human Estrogen Receptor" Journal of the American Chemical Society (2012) vol. 134, pp. 3942-3945.
Molina, "A Decade of Rituximab: Improving Survival Outcomes in Non-Hodgkin's Lymphoma" Annu. Rev. Med. (2008) vol. 59 pp. 237-250.
Morgan et al., "Case Report of a Serious Adverse Event Following the Administration of T Cells Transduced With a Chimeric Anitgen Receptor Recognizing ErbB2," Mol. Ther. 18(4): 843-851 (2010).
Moritz and Groner, "A spacer region between the single chain antibody- and the CD3 zeta-chain domain of chimeric T cell receptor components is required for efficient ligand binding and signaling activity," Gene Therapy 2(8): 539-546 (1995).
Moritz et al., "Cytotoxic T lymphocytes with a grafted recognition specificity for ERBB2-expressing tumor cells" Proc. Natl. Acad. Sci (1994) vol. 91 pp. 4318-4322.
Naldini et al., "In Vivo Gene Delivery and Stable Transduction of Nondividing Cells by a Lentiviral Vector" Science (1996) vol. 272 pp. 263-267.
NCBI accession HM_852952 accessed Sep. 29, 2015 from http://www.ncbi.nlm.nih.gov/nuccore/hm852952.
Nicholson et al., "Construction and Characterisation of a Function CD19 Specific Single Chain Fv Fragment for Immunotherapy of B Lineage Leukaemia and Lymphoma," Molecular Immunology 34(I6-I7): 1157-1165 (1997).
Park and Brentjens "Adoptive Immunotherapy for B-cell Malignancies with Autologous Chimeric Antigen Receptor Modified Tumor Targeted T Cells" Discovery Medicine (2010) vol. 9 No. 47 pp. 277-288.
Park et al. "Adoptive Transfer of Chimeric Antigen Receptor Re-directed Cytolytic T Lymphocyte Clones in Patients with Neuroblastoma", Molecular Therapy (2007) vol. 15 No. 4 pp. 825-833.
Patel et al., "Impact of chimeric immune receptor extracellular protein domains on T cell function" Gene Therapy (1999) vol. 6 pp. 412-419.
Porter et al. "Chimeric Antigen Receptor-Modified T Cells in Chronic Lymphoid Leukemia", The New England Journal of Medicine (2011) vol. 365 No. 8 pp. 725-733.
Porter et al., "A phase 1 trial of donor lumphocyte infusions expanded and activated ex vivo via CD3/CD28 costimulation" Blood (2006) vol. 107 No. 4 pp. 1325-1331.
Porter et al., "Chimeric Antigen Receptor Therapy for B-cell Malignancies" Journal of Cancer (2011) vol. 2 pp. 331-332.
Pratt et al. "Small-molecule-mediated rescue of protein function by an inducible proteolytic shunt" PNAS (2007) vol. 104, No. 27, pp. 11209-11214.
Pule et al., "Virus-specific T cells engineered to coexpress tumor-specific receptors: persistence and antitumor activity in individuals with neuroblastoma" Nat. Med. (2008) vol. 14 No. 11 pp. 1264-1270.
Quintino et al. "Functional Neuroprotection and Efficient Regulation of GDNF Using Destabilizing Domains in a Rodent Model of Parkinson's Disease" Molecular Therapy (2013) vol. 21, No. 12, pp. 2169-2180.

(56) References Cited

OTHER PUBLICATIONS

Rapoport et al., "Restoration of immunity in lymphopenic individuals with cancer by vaccination and adoptive T-cell transfer" Nature Medicine (2005) vol. 11 No. 11 pp. 1230-1237.
Rivera et al. "Regulation of Protein Secretion Through Controlled Aggregation in the Endoplasmic Reticulum" Science (2000) vol. 287, pp. 826-830.
Roederer, "T-cell dynamics of immunodeficiency" Nature Medicine (1995) vol. 1 No. 7 pp. 621-622.
Romeo et al., "Cellular immunity to HIV activated by CD4 fused to T cell or Fc receptor polypeptides," Cell 64:1037-1046 (1991).
Sabbagh et al., "TNF family ligands define niches for T cell memory" Trends in Immunology (2007) vol. 28 No. 8 pp. 333-339.
Sadelain et al. "The promise and potential pitfalls of chimeric antigen receptors." Current Opinion Immunology (2009) vol. 21 No. 2 pp. 215-223.
Sadelain et al., "Targeting Tumours with Genetically Enhanced T Lymphocytes," Nature Reviews: Cancer 3: 35-45 (2003).
Savoldo et al., "CD28 costimulation improves expansion and persistence of chimeric antigen receptor-modified T cells in lymphoma patients" The Journal of Clinical Investigation (2011) vol. 121 No. 5 pp. 1822-1826.
Sebestyen et al., "Human TCR That Incorporate CD3 Induce Highly Preferred Pairing between TCR and Chains following Gene Transfer" Journal of Immunology (2008) vol. 180 pp. 7736-7746.
Shirasu et al., "Functional Design of Chimeric T-Cell Antigen Receptors for Adoptive Immunotherapy of Cancer: Architecture and Outcomes," AntiCancer Res. 32: 2377-2384 (2012).
Sorror et al., "Outcomes after allogeneic hematopoietic cell transplantation with nonmyeloablative or myeloablative conditioning regimens for treatment of lymphoma and chronic lymphocytic leukemia" Blood (2008) vol. 111 No. 1 pp. 446-452.

\* cited by examiner

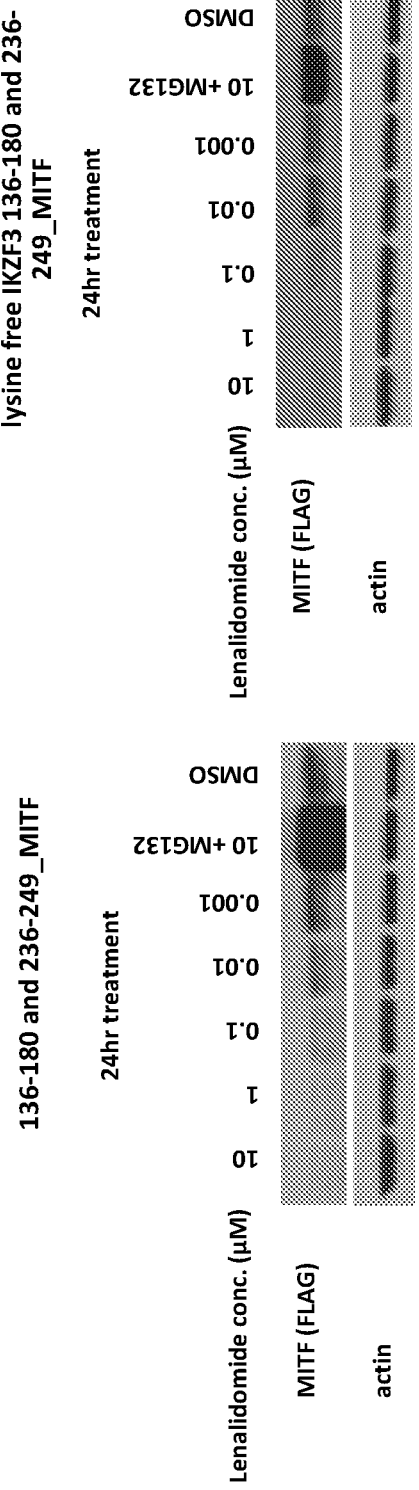
FIG. 6A
FIG. 6B
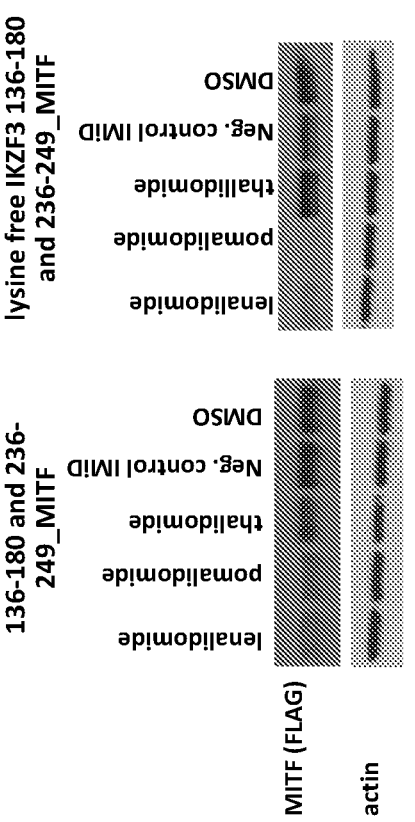
FIG. 6D
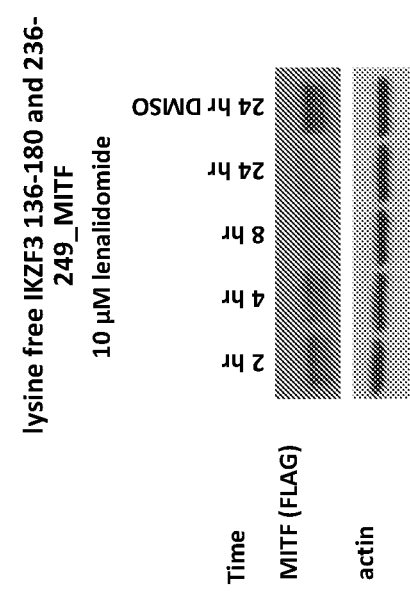
FIG. 6C

CD19_IKZF3 136-180 and 236-249
6hr Treatment

CD19_IKZF3 136-180 and 236-249
1hr Treatment

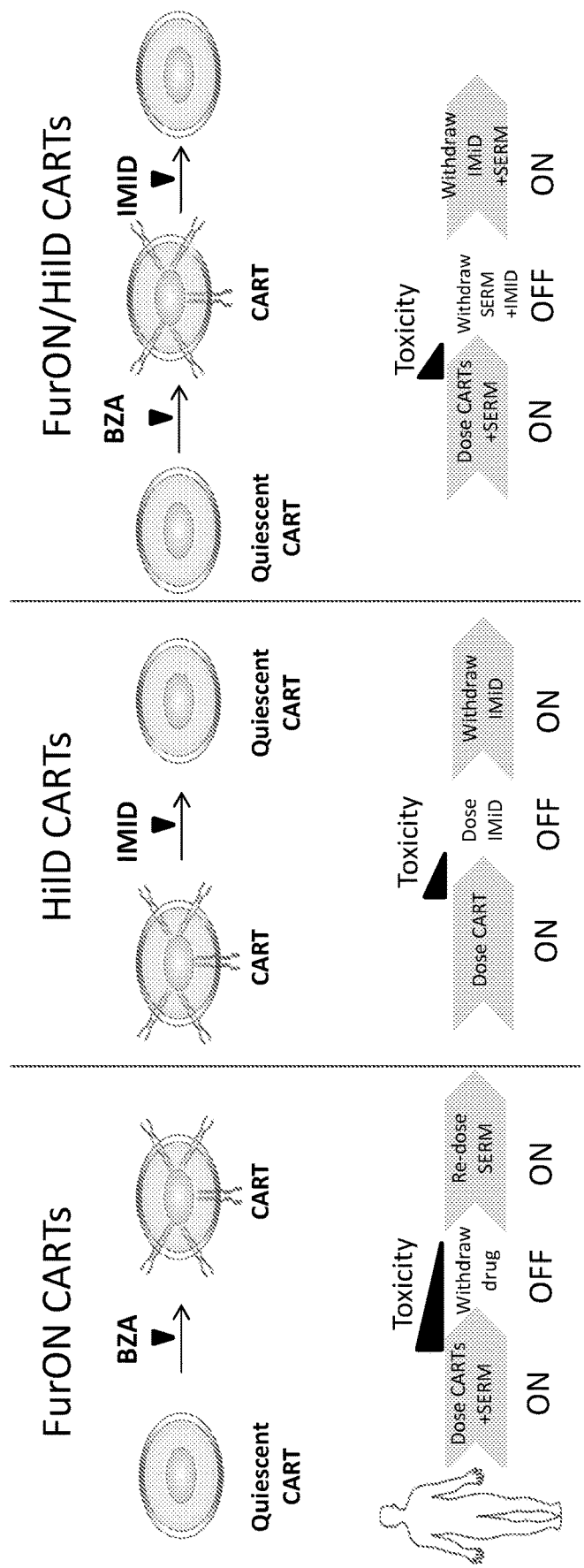

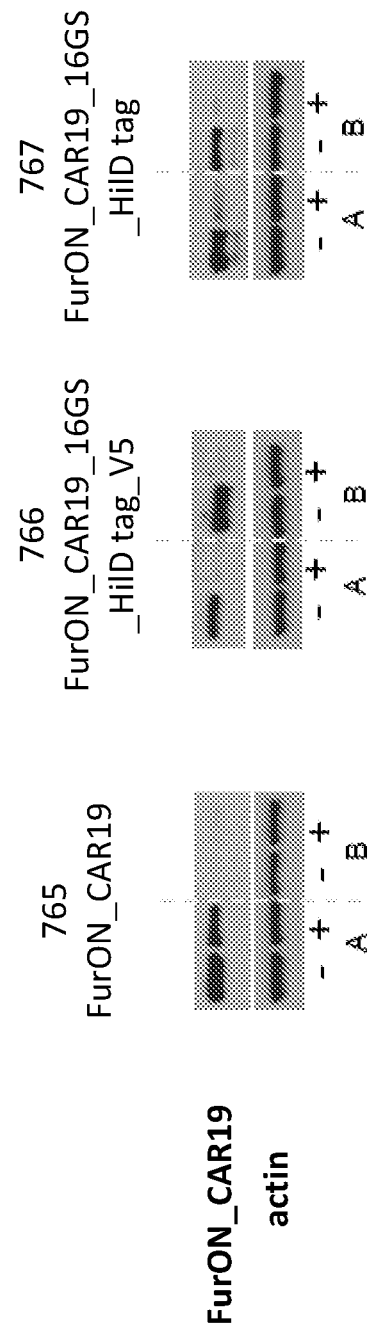

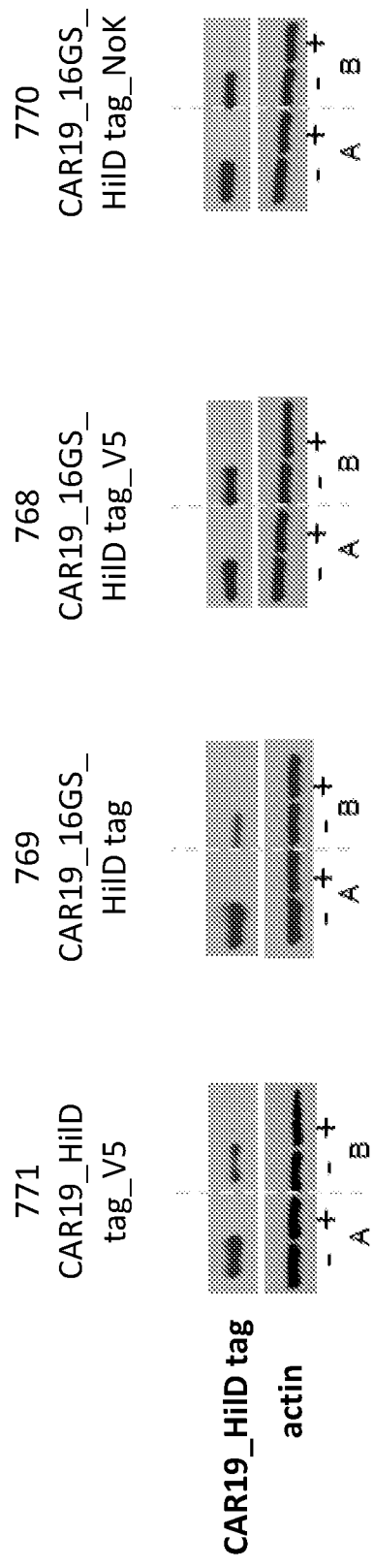

769 (CAR19_16GS_HilD tag)

771 (CAR19_HilD tag_V5)

768 (CAR19_16GS_HilD tag_V5)

6761 (CAR19_16KGS_HilD tag_V5)

770 (CAR19_16GS_HiiD tag_NoK)

773 (HiiD tag_CAR19_modSigPep)

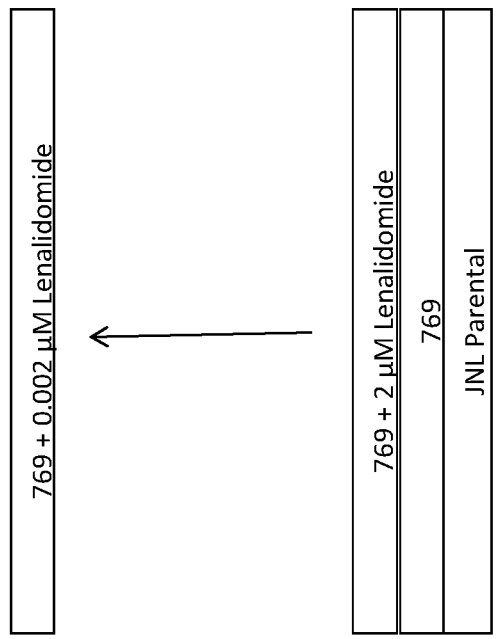
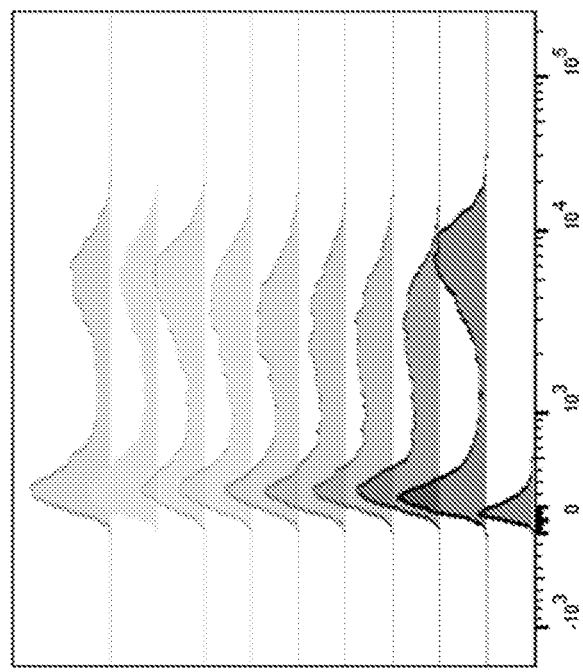
FIG. 18A

Tau isoform used: 0N4R

Linker 1: GGGGSGGGGTGGGGSG (SEQ ID NO: 28)
Linker 2: SGSETPGTSESATPES (SEQ ID NO: 37)
Linker 3: *Either*: 16xGS: GGGGSGGGGTGGGGSG (SEQ ID NO: 28)
33xGS: GGGGSGGGGTGGGGSGGGGGTGGGGSGGGGTGGGGSGGGGTG (SEQ ID NO: 38)
"XTEN": SGSETPGTSESATPES (SEQ ID NO: 37)
16xGS – V5: GGGGSGGGGTGGGGSGGGGKPIPNPLLGLASTGSG (SEQ ID NO: 39)

Biotin ligase reference: Kim et al., "An improved smaller biotin ligase for BioID proximity labeling," Mol Biol Cell, 2016

Constructs:
1: HiD – Tau – 16xGS – BioID
2: HiD – Tau – 33xGS – BioID
3: Tau – 16xGS – BioID (no HiD)
4: HiD – Tau – 16xGS – V5 - BioID
5: HiD – Tau – XTEN– BioID
6: Tau – 16xGS – V5 – BioID (no HiD)

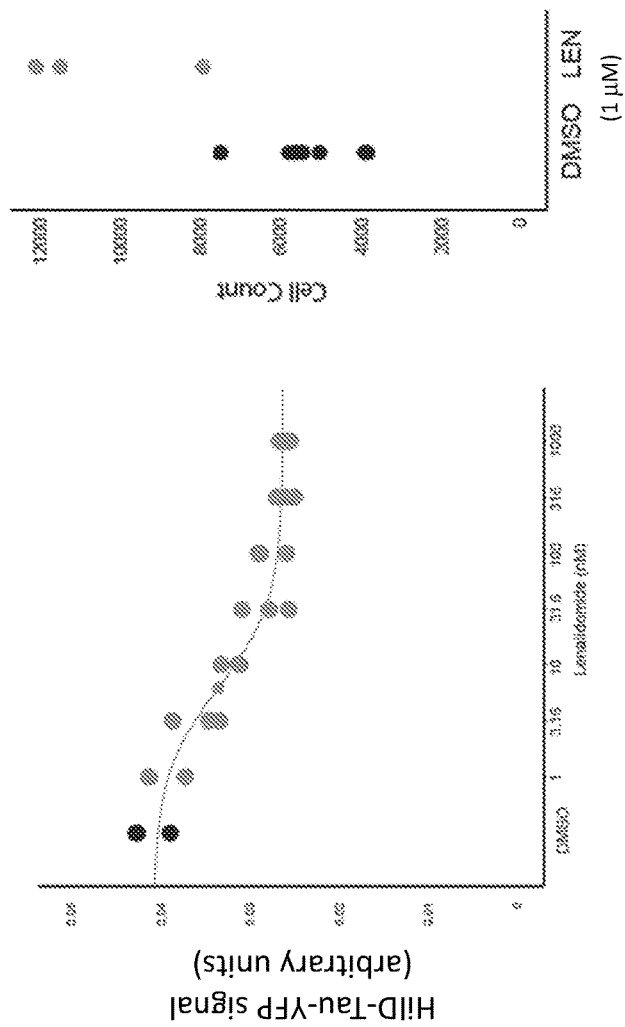
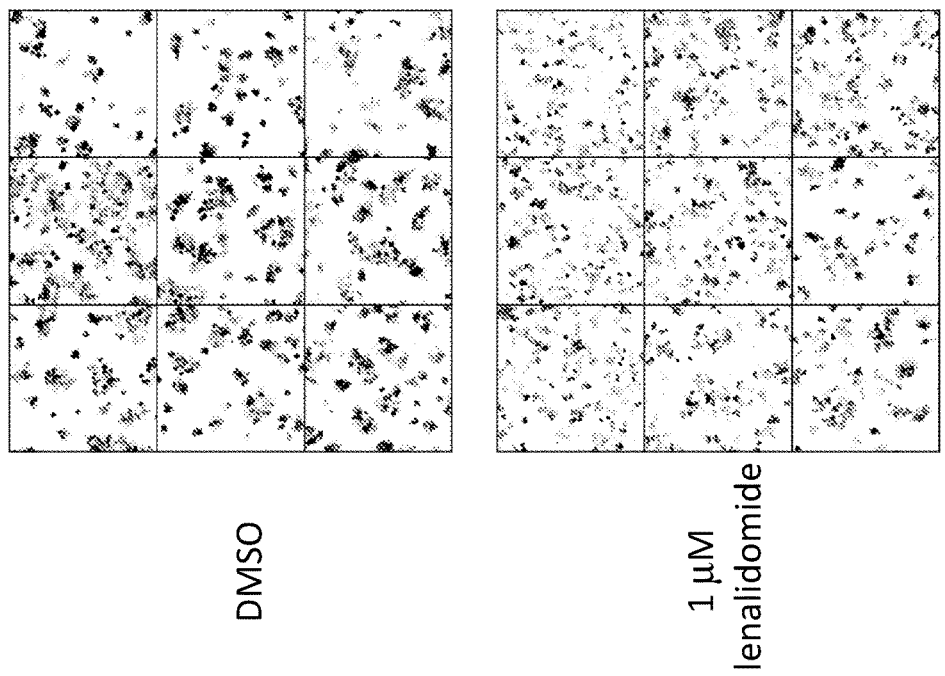
FIG. 25A  FIG. 25B  FIG. 25C

FIG. 31C
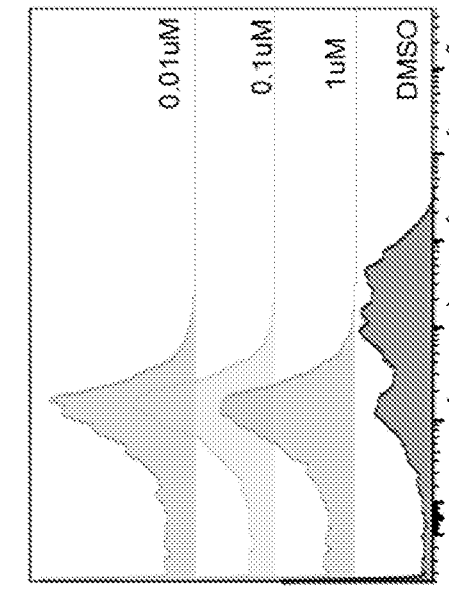
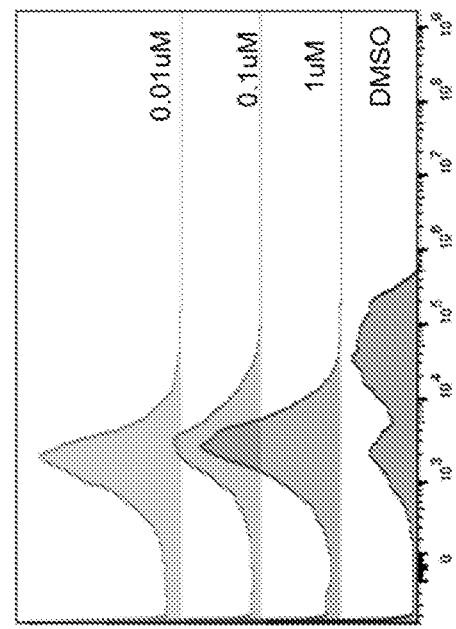
| Conc. Of Leno In uM | 24Hrs | | 48Hrs | |
|---|---|---|---|---|
| | %CAR | MFI | %CAR | MFI |
| 0.01 | 14.2 | 10260 | 1.46 | 1267 |
| 0.1 | 14.6 | 10134 | 1.33 | 1271 |
| 1 | 11 | 4971 | 1.02 | 1129 |
| DMSO | 57 | 50823 | 45.8 | 20914 |

COMPOSITIONS AND METHODS FOR SELECTIVE PROTEIN DEGRADATION

RELATED APPLICATION

This application is a U.S. National Stage Application under 35 U.S.C. § 371 of International Application No. PCT/US2018/056472, filed Oct. 18, 2018, which claims priority to U.S. Ser. No. 62/574,188 filed Oct. 18, 2017 contents of each of which are incorporated herein by reference in their entireties.

SEQUENCE LISTING

The instant application contains a Sequence Listing which has been submitted electronically in ASCII format and is hereby incorporated by reference in its entirety. Said ASCII copy, created on Oct. 17, 2018, is named N2067-7136WO-_SL.txt and is 2,052,554 bytes in size.

BACKGROUND OF THE INVENTION

Many therapeutic proteins have been developed as important medications for preventing or treating diseases. Side effects can occur during or after the treatment, varying from a loss of drug efficacy to serious toxicities. It is desirable to develop strategies to modulate the expression level of the therapeutic proteins, e.g., to modulate the levels of the therapeutic proteins to increase efficacy and/or decrease side effects.

SUMMARY OF THE INVENTION

The present disclosure provides, at least in part, a fusion polypeptide comprising a compound of Formula (I) (COF1)/CRBN-binding polypeptide, a compound of Formula (II) (COF2)/CRBN-binding polypeptide, or a compound of Formula (III) (COF3)/CRBN-binding polypeptide for targeted protein inactivation. In some embodiments, the fusion polypeptide includes one or more COF1/CRBN-, COF2/CRBN-, or COF3/CRBN-binding polypeptides and one or more heterologous polypeptides, e.g., polypeptides of interest. The COF1/CRBN-, COF2/CRBN-, or COF3/CRBN-binding polypeptide can be operably linked to the heterologous polypeptide, e.g., via a linker. In some embodiments, in the presence of COF1 or COF2 (such as thalidomide and derivatives thereof (e.g., lenalidomide, pomalidomide, and thalidomide)), or in the presence of COF3 (e.g., a compound disclosed in Table 29) the COF1/CRBN-, COF2/CRBN-, or COF3/CRBN-binding polypeptide alters the level and/or activity of the fusion polypeptide; for example, increases degradation, e.g., proteosomal degradation, of the fusion polypeptide. In some embodiments, the degradation of the fusion polypeptide is ubiquitin-dependent.

Without wishing to be bound by theory, in some embodiments, the COF1/CRBN-, COF2/CRBN-, or COF3/CRBN-binding polypeptide provides an amino acid sequence and/or a structural motif that, in the presence of COF1 or COF2 (such as thalidomide and derivatives thereof (e.g., lenalidomide, pomalidomide, and thalidomide)), or in the presence of COF3 (e.g., a compound disclosed in Table 29), results in a post-translational modification (e.g., ubiquitination) of the fusion polypeptide, resulting in a modified, e.g., ubiquitinated, fusion polypeptide. For example, one or more amino acids, e.g., lysine or methionine, in the fusion polypeptide can be ubiquitinated, in the presence of COF1, COF2, or COF3. In some embodiments, the ubiquitinated fusion polypeptide is selectively degraded. In some embodiments, the post-translational modification of the fusion polypeptide increases the degradation (e.g., an increased level and/or rate of degradation) of the fusion polypeptide. In some embodiments, the level and/or rate of degradation is increased by at least 1.5-, 2-, 3-, 4-, 5-, 10-, 20-, 30-, 40-, or 50-fold relative to the level and/or rate of degradation of a reference polypeptide, e.g., the fusion polypeptide in the absence of COF1, COF2, or COF3, the heterologous polypeptide, or a fusion of the heterologous polypeptide without the COF1/CRBN-, COF2/CRBN-, or COF3/CRBN-binding polypeptide, or with a moiety other than the COF1/CRBN-, COF2/CRBN-, or COF3/CRBN-binding polypeptide.

In one aspect, provided herein is a fusion polypeptide comprising a compound of Formula (I) (COF1)/CRBN-binding polypeptide and a heterologous polypeptide, wherein the compound of Formula (I) is:

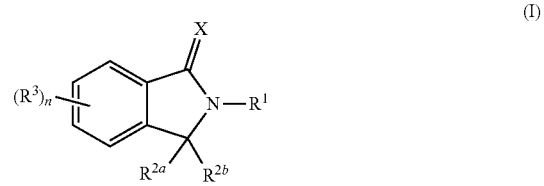

or a pharmaceutically acceptable salt, ester, hydrate, solvate, or tautomer thereof, wherein:

X is O or S;

$R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached form a carbonyl group or a thiocarbonyl group;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)$_x$N($R^C$)($R^D$), or —N($R^C$)S(O)$_x R^E$, wherein each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)$_x$N($R^C$)($R^D$), —N($R^C$)S(O)$_x R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with one or more $R^8$;

each $R^7$ is independently halo, oxo, cyano, —O$R^B$, —N($R^C$)($R^D$), —C(O)N($R^C$)($R^D$), or —N($R^C$)C(O)$R^A$;

each $R^8$ is independently $C_1$-$C_6$ alkyl, cyano, —O$R^B$, —N($R^C$)($R^D$), —C(O)N($R^C$)($R^D$), or —N($R^C$)C(O)$R^A$;

n is 0, 1, 2, 3 or 4; and x is 0, 1, or 2.

In some embodiments, the heterologous polypeptide is a heterologous mammalian polypeptide. In some embodiments, the heterologous polypeptide is a heterologous bacterial polypeptide. In some embodiments, the heterologous polypeptide is a heterologous viral polypeptide. In some embodiments, the heterologous polypeptide comprises an amino acid sequence from, or derived from, a mammalian polypeptide, a bacterial polypeptide, a viral polypeptide, a plant polypeptide, a yeast polypeptide, a fungi polypeptide, an archaebacterial polypeptide, a fish, e.g., Zebrafish, polypeptide. In some embodiments, the heterologous polypeptide comprises a polypeptide in Table 2, e.g., a cytoplasmic and/or nuclear polypeptide, or a transmembrane polypeptide as described in Table 2.

In some embodiments, the COF1/CRBN-binding polypeptide is fused to the heterologous polypeptide. In some embodiments, the COF1/CRBN-binding polypeptide and the heterologous polypeptide are linked by a peptide bond. In some embodiments, the COF1/CRBN-binding polypeptide and the heterologous polypeptide are linked by a bond other than a peptide bond. In some embodiments, the heterologous polypeptide is linked directly to the COF1/CRBN-binding polypeptide. In some embodiments, the heterologous polypeptide is linked indirectly to the COF1/CRBN-binding polypeptide. In some embodiments, the COF1/CRBN-binding polypeptide and the heterologous polypeptide are operatively linked via a linker, e.g., a glycine-serine linker, e.g., a linker comprising the amino acid sequence of SEQ ID NO: 28. In some embodiments, the linker comprises an amino acid sequence selected from the group consisting of SEQ ID NOs: 28, 37, 38, 39, and 99.

In some embodiments, the COF1/CRBN-binding polypeptide is linked to the C-terminus of the heterologous polypeptide. In some embodiments, the COF1/CRBN-binding polypeptide is linked to the N-terminus of the heterologous polypeptide. In some embodiments, the COF1/CRBN-binding polypeptide is at the middle of the heterologous polypeptide.

In some embodiments, the association of the COF1/CRBN-binding polypeptide with cereblon (CRBN) in the absence of COF1 is no more than, e.g., 0.01%, 0.1%, 1%, 5%, 10%, 15%, or 20%, of the association of the COF1/CRBN-binding polypeptide with CRBN in the presence of COF1, e.g., an excess of COF1, e.g., as measured by an assay described herein, e.g., immunoprecipitation. In some embodiments, the COF1/CRBN-binding polypeptide does not bind to CRBN in the absence of COF1. In some embodiments, the association of the fusion polypeptide with CRBN in the absence of COF1 is no more than, e.g., 0.01%, 0.1%, 1%, 5%, 10%, 15%, or 20%, of the association of the fusion polypeptide with CRBN in the presence of COF1, e.g., an excess of COF1, e.g., as measured by an assay described herein, e.g., immunoprecipitation. In some embodiments, the fusion polypeptide does not bind to CRBN in the absence of COF1. In some embodiments, the association or binding is as measured in a mammalian cell, e.g., a human cell.

In some embodiments, the ubiquitination of the heterologous polypeptide in the absence of COF1 is no more than, e.g., 0.01%, 0.1%, 1%, 10%, 20%, 30%, 40%, 50%, 60%, or 70%, of the ubiquitination of the heterologous polypeptide in the presence of COF1, e.g., an excess of COF1, e.g., as measured by an assay described herein. In some embodiments, the ubiquitination of the fusion polypeptide in the absence of COF1 is no more than, e.g., 0.01%, 0.1%, 1%, 10%, 20%, 30%, 40%, 50%, 60%, or 70%, of the ubiquitination of the fusion polypeptide in the presence of COF1, e.g., an excess of COF1, e.g., as measured by an assay described herein. In some embodiments, the heterologous polypeptide or the fusion polypeptide is ubiquitinated at one or more lysine or methionine residues in the presence of COF1. In some embodiments, the ubiquitination is as measured in a mammalian cell, e.g., a human cell.

In some embodiments, the degradation of the fusion polypeptide in the absence of COF1 is no more than, e.g., 0.01%, 0.1%, 1%, 10%, 20%, 30%, 40%, 50%, 60%, or 70% of the degradation of the fusion polypeptide in the presence of COF1, e.g., an excess of COF1, e.g., as measured by an assay described herein, e.g., a Western blot analysis or a flow cytometry analysis. In some embodiments, the degradation of the fusion polypeptide is mediated by ubiquitination in the presence of COF1. In some embodiments, the degradation of the fusion polypeptide is mediated by the lysosome. In some embodiments, the degradation is as measured in a mammalian cell, e.g., a human cell.

In some embodiments, the fusion polypeptide is a cell surface polypeptide. In some embodiments, the rate of recycling of the fusion polypeptide from the cell surface to an intracellular compartment in the absence of COF1 is no more than, e.g., 10%, 20%, 30%, 40%, 50%, 60%, 70%, 80%, or 90% of the recycling of the fusion polypeptide from the cell surface to an intracellular compartment in the presence of COF1, e.g., an excess of COF1, e.g., as measured by an assay described herein. In some embodiments, the recycling is as measured in a mammalian cell, e.g., a human cell.

In some embodiments, the COF1/CRBN-binding polypeptide is between 10 and 95 amino acid residues in length, between 15 and 90 amino acid residues in length, between 20 and 85 amino acid residues in length, between 25 and 80 amino acid residues in length, between 30 and 75 amino acid residues in length, between 35 and 70 amino acid residues in length, between 40 and 65 amino acid residues in length, between 45 and 65 amino acid residues in length, between 50 and 65 amino acid residues in length, or between 55 and 65 amino acid residues in length.

In some embodiments, the COF1/CRBN-binding polypeptide comprises a beta turn. In some embodiments, the COF1/CRBN-binding polypeptide comprises a beta turn of IKZF1 or IKZF3 (e.g., human IKZF1 or IKZF3). In some embodiments, the COF1/CRBN-binding polypeptide comprises a beta hairpin. In some embodiments, the COF1/CRBN-binding polypeptide comprises a beta hairpin of IKZF1 or IKZF3 (e.g., human IKZF1 or IKZF3). In some embodiments, the COF1/CRBN-binding polypeptide comprises a beta strand. In some embodiments, the COF1/CRBN-binding polypeptide comprises a beta strand of IKZF1 or IKZF3 (e.g., human IKZF1 or IKZF3). In some embodiments, the COF1/CRBN-binding polypeptide comprises an alpha helix. In some embodiments, the COF1/CRBN-binding polypeptide comprises an alpha helix of IKZF1 or IKZF3 (e.g., human IKZF1 or IKZF3). In some embodiments, the COF1/CRBN-binding polypeptide comprises, from N-terminus to C-terminus, a first beta strand, a beta hairpin, a second beta strand, and a first alpha helix. In some embodiments, the COF1/CRBN-binding polypeptide comprises, from N-terminus to C-terminus, a first beta strand, a beta hairpin, a second beta strand, and a first alpha helix of IKZF1 or IKZF3 (e.g., human IKZF1 or IKZF3). In some embodiments, the COF1/CRBN-binding polypeptide comprises, from N-terminus to C-terminus, a first beta strand, a beta hairpin, a second beta strand, a first alpha helix, and a second alpha helix. In some embodiments, the COF1/CRBN-binding polypeptide comprises, from N-terminus to C-terminus, a first beta strand, a beta hairpin, a second beta strand, a first alpha helix, and a second alpha helix of IKZF1 or IKZF3 (e.g., human IKZF1 or IKZF3). In some embodiments, the beta hairpin and the second alpha helix are separated by no more than 60, 50, 40, or 30 amino acid residues.

In some embodiments, the COF1/CRBN-binding polypeptide comprises a COF1/CRBN-binding sequence from a naturally occurring polypeptide or a COF1/CRBN-binding variant thereof. In some embodiments, the COF1/CRBN-binding polypeptide comprises a COF1/CRBN-binding sequence from a naturally occurring IKZF polypeptide or a COF1/CRBN-binding variant thereof. In some embodiments, the COF1/CRBN-binding polypeptide comprises a COF1/CRBN-binding sequence from a naturally occurring IKZF1, IKZF2, IKZF3, IKZF4, or IKZF5, or a COF1/CRBN-binding variant thereof. In some embodiments, the COF1/CRBN-binding sequence comprises two or more discontinuous sequences from the naturally occurring polypeptide, e.g., a naturally occurring IKZF polypeptide, e.g., a naturally occurring IKZF1, IKZF2, IKZF3, IKZF4, or IKZF5.

In some embodiments, the COF1/CRBN-binding polypeptide comprises an IKZF polypeptide or a structural motif thereof.

In some embodiments, the IKZF polypeptide is an IKZF1 polypeptide, an IKZF3 polypeptide, an IKZF2 polypeptide having H141Q substitution (numbered according to SEQ ID NO: 21), or an IKZF4 polypeptide having H188Q substitution (numbered according to SEQ ID NO: 22).

In some embodiments, the COF1/CRBN-binding polypeptide comprises sufficient amino acid sequence and/or a structural motif from IKZF (e.g., IKZF1 or IKZF3) that:
i) the association of the COF1/CRBN-binding polypeptide with CRBN in the absence of COF1 is no more than, e.g., 0.01%, 0.1%, 1%, 5%, 10%, 15%, or 20%, of the association of the COF1/CRBN-binding polypeptide with CRBN in the presence of COF1, e.g., an excess of COF1, e.g., as measured by an assay described herein, e.g., immunoprecipitation;
ii) the association of the fusion polypeptide with CRBN in the absence of COF1 is no more than, e.g., 0.01%, 0.1%, 1%, 5%, 10%, 15%, or 20% of the association of the fusion polypeptide with CRBN in the presence of COF1, e.g., an excess of COF1, e.g., as measured by an assay described herein, e.g., immunoprecipitation;
iii) the ubiquitination of the heterologous polypeptide in the absence of COF1 is no more than, e.g., 0.01%, 0.1%, 1%, 10%, 20%, 30%, 40%, 50%, 60%, or 70%, of the ubiquitination of the heterologous polypeptide in the presence of COF1, e.g., an excess of COF1, e.g., as measured by an assay described herein;
iv) the ubiquitination of the fusion polypeptide in the absence of COF1 is no more than, e.g., 0.01%, 0.1%, 1%, 10%, 20%, 30%, 40%, 50%, 60%, or 70%, of the ubiquitination of the fusion polypeptide in the presence of COF1, e.g., an excess of COF1, e.g., as measured by an assay described herein; or
v) the degradation of the fusion polypeptide in the absence of COF1 is no more than, e.g., 0.01%, 0.1%, 1%, 10%, 20%, 30%, 40%, 50%, 60%, or 70%, of the degradation of the fusion polypeptide in the presence of COF1, e.g., an excess of COF1, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF1/CRBN-binding polypeptide comprises about 10 to about 95 amino acid residues, about 15 to about 90 amino acid residues, about 20 to about 85 amino acid residues, about 25 to about 80 amino acid residues, about 30 to about 75 amino acid residues, about 35 to about 70 amino acid residues, about 40 to about 65 amino acid residues, about 45 to about 65 amino acid residues, about 50 to about 65 amino acid residues, or about 55 to about 65 amino acid residues of IKZF1 or IKZF3.

In some embodiments, the COF1/CRBN-binding polypeptide comprises sufficient amino acid sequence and/or a structural motif from amino acid residues 136-180 of IKZF3 (numbered according to SEQ ID NO: 19) (e.g., sufficient amino acid sequence and/or a structural motif from amino acid residues 136-180 of SEQ ID NO: 19) that:
i) the association of the COF1/CRBN-binding polypeptide with CRBN in the absence of COF1 is no more than, e.g., 0.01%, 0.1%, 1%, 5%, 10%, 15%, or 20%, of the association of the COF1/CRBN-binding polypeptide with CRBN in the presence of COF1, e.g., an excess of COF1, e.g., as measured by an assay described herein, e.g., immunoprecipitation;
ii) the association of the fusion polypeptide with CRBN in the absence of COF1 is no more than, e.g., 0.01%, 0.1%, 1%, 5%, 10%, 15%, or 20% of the association of the fusion polypeptide with CRBN in the presence of COF1, e.g., an excess of COF1, e.g., as measured by an assay described herein, e.g., immunoprecipitation;
iii) the ubiquitination of the heterologous polypeptide in the absence of COF1 is no more than, e.g., 0.01%, 0.1%, 1%, 10%, 20%, 30%, 40%, 50%, 60%, or 70%, of the ubiquitination of the heterologous polypeptide in the presence of COF1, e.g., an excess of COF1, e.g., as measured by an assay described herein;
iv) the ubiquitination of the fusion polypeptide in the absence of COF1 is no more than, e.g., 0.01%, 0.1%, 1%, 10%, 20%, 30%, 40%, 50%, 60%, or 70%, of the ubiquitination of the fusion polypeptide in the presence of COF1, e.g., an excess of COF1, e.g., as measured by an assay described herein; or
v) the degradation of the fusion polypeptide in the absence of COF1 is no more than, e.g., 0.01%, 0.1%, 1%, 10%, 20%, 30%, 40%, 50%, 60%, or 70%, of the degradation of the fusion polypeptide in the presence of COF1, e.g., an excess of COF1, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF1/CRBN-binding polypeptide comprises amino acid residues 136-180 of IKZF3 (numbered according to SEQ ID NO: 19) (e.g., the COF1/CRBN-binding polypeptide comprises the amino acid sequence of SEQ ID NO: 5) or a sequence that differs from amino acid residues 136-180 of IKZF3 (numbered according to SEQ ID NO: 19) by no more than 1, 2, 3, 4, 5, 10, 15, 20, 25, 30, 35, or 40 amino acid residues (e.g., a sequence that differs from amino acid residues 136-180 of SEQ ID NO: 19 by no more than 1, 2, 3, 4, 5, 10, 15, 20, 25, 30, 35, or 40 amino acid residues) (e.g., a sequence having no more than 1, 2, 3, 4, 5, 10, 15, 20, 25, 30, 35, or 40 amino acid substitutions from amino acid residues 136-180 of SEQ ID NO: 19).

In some embodiments, the COF1/CRBN-binding polypeptide comprises sufficient amino acid sequence and/or a structural motif from amino acid residues 136-170 of IKZF3 (numbered according to SEQ ID NO: 19) (e.g., sufficient amino acid sequence and/or a structural motif from amino acid residues 136-170 of SEQ ID NO: 19) that:

i) the association of the COF1/CRBN-binding polypeptide with CRBN in the absence of COF1 is no more than, e.g., 0.01%, 0.1%, 1%, 5%, 10%, 15%, or 20%, of the association of the COF1/CRBN-binding polypeptide with CRBN in the presence of COF1, e.g., an excess of COF1, e.g., as measured by an assay described herein, e.g., immunoprecipitation;

ii) the association of the fusion polypeptide with CRBN in the absence of COF1 is no more than, e.g., 0.01%, 0.1%, 1%, 5%, 10%, 15%, or 20% of the association of the fusion polypeptide with CRBN in the presence of COF1, e.g., an excess of COF1, e.g., as measured by an assay described herein, e.g., immunoprecipitation;

iii) the ubiquitination of the heterologous polypeptide in the absence of COF1 is no more than, e.g., 0.01%, 0.1%, 1%, 10%, 20%, 30%, 40%, 50%, 60%, or 70%, of the ubiquitination of the heterologous polypeptide in the presence of COF1, e.g., an excess of COF1, e.g., as measured by an assay described herein;

iv) the ubiquitination of the fusion polypeptide in the absence of COF1 is no more than, e.g., 0.01%, 0.1%, 1%, 10%, 20%, 30%, 40%, 50%, 60%, or 70%, of the ubiquitination of the fusion polypeptide in the presence of COF1, e.g., an excess of COF1, e.g., as measured by an assay described herein; or v) the degradation of the fusion polypeptide in the absence of COF1 is no more than, e.g., 0.01%, 0.1%, 1%, 10%, 20%, 30%, 40%, 50%, 60%, or 70%, of the degradation of the fusion polypeptide in the presence of COF1, e.g., an excess of COF1, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF1/CRBN-binding polypeptide comprises amino acid residues 136-170 of IKZF3 (numbered according to SEQ ID NO: 19) (e.g., the COF1/CRBN-binding polypeptide comprises the amino acid sequence of SEQ ID NO: 6) or a sequence that differs from amino acid residues 136-170 of IKZF3 (numbered according to SEQ ID NO: 19) by no more than 1, 2, 3, 4, 5, 10, 15, 20, 25, or 30 amino acid residues (e.g., a sequence that differs from amino acid residues 136-170 of SEQ ID NO: 19 by no more than 1, 2, 3, 4, 5, 10, 15, 20, 25, or 30 amino acid residues) (e.g., a sequence having no more than 1, 2, 3, 4, 5, 10, 15, 20, 25, or 30 amino acid substitutions from amino acid residues 136-170 of SEQ ID NO: 19).

In some embodiments, one, two, three or all of the following amino acid residues remain unaltered: glutamine at position 147, cysteine at position 148, glutamine at position 150, glycine at position 152, leucine at position 161, or leucine at position 162, numbered according to SEQ ID NO: 19. In some embodiments, glutamine at position 147 remains unaltered, numbered according to SEQ ID NO: 19. In some embodiments, cysteine at position 148 remains unaltered, numbered according to SEQ ID NO: 19. In some embodiments, glutamine at position 150 remains unaltered, numbered according to SEQ ID NO: 19. In some embodiments, glycine at position 152 remains unaltered, numbered according to SEQ ID NO: 19. In some embodiments, leucine at position 161 remains unaltered, numbered according to SEQ ID NO: 19. In some embodiments, leucine at position 162 remains unaltered, numbered according to SEQ ID NO: 19.

In some embodiments, the COF1/CRBN-binding polypeptide comprises amino acid residues 136-139 of IKZF3 (numbered according to SEQ ID NO: 19), e.g., the COF1/CRBN-binding polypeptide comprises the amino acid sequence of SEQ ID NO: 40.

In some embodiments, the COF1/CRBN-binding polypeptide comprises amino acid residues 136-180 of IKZF3 (numbered according to SEQ ID NO: 19). In some embodiments, the COF1/CRBN-binding polypeptide comprises the amino acid sequence of SEQ ID NO: 5. In some embodiments, the COF1/CRBN-binding polypeptide comprises the amino acid sequence of SEQ ID NO: 77. In some embodiments, the COF1/CRBN-binding polypeptide consists of the amino acid sequence of SEQ ID NO: 5. In some embodiments, the COF1/CRBN-binding polypeptide consists of the amino acid sequence of SEQ ID NO: 5.

In some embodiments, the COF1/CRBN-binding polypeptide comprises amino acid residues 136-170 of IKZF3 (numbered according to SEQ ID NO: 19). In some embodiments, the COF1/CRBN-binding polypeptide comprises the amino acid sequence of SEQ ID NO: 6. In some embodiments, the COF1/CRBN-binding polypeptide comprises the amino acid sequence of SEQ ID NO: 78. In some embodiments, the COF1/CRBN-binding polypeptide consists of the amino acid sequence of SEQ ID NO: 6. In some embodiments, the COF1/CRBN-binding polypeptide consists of the amino acid sequence of SEQ ID NO: 78.

In some embodiments, the COF1/CRBN-binding polypeptide comprises sufficient amino acid sequence and/or a structural motif from amino acid residues 236-249 of IKZF3 (numbered according to SEQ ID NO: 19) (e.g., sufficient amino acid sequence and/or a structural motif from amino acid residues 236-249 of SEQ ID NO: 19) that:

i) the association of the COF1/CRBN-binding polypeptide with CRBN in the absence of COF1 is no more than, e.g., 0.01%, 0.1%, 1%, 5%, 10%, 15%, or 20%, of the association of the COF1/CRBN-binding polypeptide with CRBN in the presence of COF1, e.g., an excess of COF1, e.g., as measured by an assay described herein, e.g., immunoprecipitation;

ii) the association of the fusion polypeptide with CRBN in the absence of COF1 is no more than, e.g., 0.01%, 0.1%, 1%, 5%, 10%, 15%, or 20% of the association of the fusion polypeptide with CRBN in the presence of COF1, e.g., an excess of COF1, e.g., as measured by an assay described herein, e.g., immunoprecipitation;

iii) the ubiquitination of the heterologous polypeptide in the absence of COF1 is no more than, e.g., 0.01%, 0.1%, 1%, 10%, 20%, 30%, 40%, 50%, 60%, or 70%, of the ubiquitination of the heterologous polypeptide in the presence of COF1, e.g., an excess of COF1, e.g., as measured by an assay described herein;

iv) the ubiquitination of the fusion polypeptide in the absence of COF1 is no more than, e.g., 0.01%, 0.1%, 1%, 10%, 20%, 30%, 40%, 50%, 60%, or 70%, of the ubiquitination of the fusion polypeptide in the presence of COF1, e.g., an excess of COF1, e.g., as measured by an assay described herein; or v) the degradation of the fusion polypeptide in the absence of COF1 is no more than, e.g., 0.01%, 0.1%, 1%, 10%, 20%, 30%, 40%, 50%, 60%, or 70%, of the degradation of the fusion polypeptide in the presence of COF1, e.g., an excess of COF1, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF1/CRBN-binding polypeptide comprises amino acid residues 236-249 of IKZF3 (numbered according to SEQ ID NO: 19) (e.g., the COF1/CRBN-binding polypeptide comprises the amino acid sequence of SEQ ID NO: 11) or a sequence that differs from amino acid residues 236-249 of IKZF3 (numbered according to SEQ ID NO: 19) by no more than 1, 2, 3, 4, 5, 6, or 7 amino acid residues (e.g., a sequence that differs from amino acid residues 236-249 of SEQ ID NO: 19 by no more than 1, 2, 3, 4, 5, 6, or 7 amino acid residues) (e.g., a sequence having no more than 1, 2, 3, 4, 5, 6, or 7 amino acid substitutions from amino acid residues 236-249 of SEQ ID NO: 19).

In some embodiments, the COF1/CRBN-binding polypeptide comprises amino acid residues 236-249 of IKZF3 (numbered according to SEQ ID NO: 19). In some embodiments, the COF1/CRBN-binding polypeptide comprises the amino acid sequence of SEQ ID NO: 11.

In some embodiments, the COF1/CRBN-binding polypeptide comprises the amino acid sequence of SEQ ID NO: 91.

In some embodiments, the COF1/CRBN-binding polypeptide comprises sufficient amino acid sequence and/or a structural motif from amino acid residues 136-180 and 236-249 of IKZF3 (numbered according to SEQ ID NO: 19) (e.g., sufficient amino acid sequence and/or a structural motif from amino acid residues 136-180 and 236-249 of SEQ ID NO: 19) that:
  i) the association of the COF1/CRBN-binding polypeptide with CRBN in the absence of COF1 is no more than, e.g., 0.01%, 0.1%, 1%, 5%, 10%, 15%, or 20%, of the association of the COF1/CRBN-binding polypeptide with CRBN in the presence of COF1, e.g., an excess of COF1, e.g., as measured by an assay described herein, e.g., immunoprecipitation;
  ii) the association of the fusion polypeptide with CRBN in the absence of COF1 is no more than, e.g., 0.01%, 0.1%, 1%, 5%, 10%, 15%, or 20% of the association of the fusion polypeptide with CRBN in the presence of COF1, e.g., an excess of COF1, e.g., as measured by an assay described herein, e.g., immunoprecipitation;
  iii) the ubiquitination of the heterologous polypeptide in the absence of COF1 is no more than, e.g., 0.01%, 0.1%, 1%, 10%, 20%, 30%, 40%, 50%, 60%, or 70%, of the ubiquitination of the heterologous polypeptide in the presence of COF1, e.g., an excess of COF1, e.g., as measured by an assay described herein;
  iv) the ubiquitination of the fusion polypeptide in the absence of COF1 is no more than, e.g., 0.01%, 0.1%, 1%, 10%, 20%, 30%, 40%, 50%, 60%, or 70%, of the ubiquitination of the fusion polypeptide in the presence of COF1, e.g., an excess of COF1, e.g., as measured by an assay described herein; or
  v) the degradation of the fusion polypeptide in the absence of COF1 is no more than, e.g., 0.01%, 0.1%, 1%, 10%, 20%, 30%, 40%, 50%, 60%, or 70%, of the degradation of the fusion polypeptide in the presence of COF1, e.g., an excess of COF1, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF1/CRBN-binding polypeptide comprises a first sequence comprising amino acid residues 136-180 of IKZF3 (numbered according to SEQ ID NO: 19) (e.g., a first sequence comprising the amino acid sequence of SEQ ID NO: 5) or a first sequence that differs from amino acid residues 136-180 of IKZF3 (numbered according to SEQ ID NO: 19) by no more than 1, 2, 3, 4, 5, 10, 15, 20, 25, 30, 35, or 40 amino acid residues (e.g., a first sequence that differs from amino acid residues 136-180 of SEQ ID NO: 19 by no more than 1, 2, 3, 4, 5, 10, 15, 20, 25, 30, 35, or 40 amino acid residues); and a second sequence comprising amino acid residues 236-249 of IKZF3 (numbered according to SEQ ID NO: 19) (e.g., a second sequence comprising the amino acid sequence of SEQ ID NO: 11) or a second sequence that differs from amino acid residues 236-249 of IKZF3 (numbered according to SEQ ID NO: 19) by no more than 1, 2, 3, 4, 5, 6, or 7 amino acid residues (e.g., a second sequence that differs from amino acid residues 236-249 of SEQ ID NO: 19 by no more than 1, 2, 3, 4, 5, 6, or 7 amino acid residues).

In some embodiments, the COF1/CRBN-binding polypeptide comprises amino acid residues 136-180 and 236-249 of IKZF3 (numbered according to SEQ ID NO: 19). In some embodiments, the COF1/CRBN-binding polypeptide comprises the amino acid sequence of SEQ ID NO: 1. In some embodiments, the COF1/CRBN-binding polypeptide comprises the amino acid sequence of SEQ ID NO: 3. In some embodiments, the COF1/CRBN-binding polypeptide consists of the amino acid sequence of SEQ ID NO: 1. In some embodiments, the COF1/CRBN-binding polypeptide consists of the amino acid sequence of SEQ ID NO: 3.

In some embodiments, the COF1/CRBN-binding polypeptide comprises a first sequence comprising amino acid residues 136-180 of IKZF3 (numbered according to SEQ ID NO: 19) and a second sequence comprising the amino acid sequence of MALEKMALEKMALE (SEQ ID NO: 91). In some embodiments, the COF1/CRBN-binding polypeptide comprises the amino acid sequence of SEQ ID NO: 14. In some embodiments, the COF1/CRBN-binding polypeptide comprises the amino acid sequence of SEQ ID NO: 85. In some embodiments, the COF1/CRBN-binding polypeptide consists of the amino acid sequence of SEQ ID NO: 14. In some embodiments, the COF1/CRBN-binding polypeptide consists of the amino acid sequence of SEQ ID NO: 85.

In some embodiments, the COF1/CRBN-binding polypeptide comprises a first sequence comprising amino acid residues 136-170 of IKZF3 (numbered according to SEQ ID NO: 19) and a second sequence comprising the amino acid sequence of MALEKMALEKMALE (SEQ ID NO: 91). In some embodiments, the COF1/CRBN-binding polypeptide comprises the amino acid sequence of SEQ ID NO: 15. In some embodiments, the COF1/CRBN-binding polypeptide comprises the amino acid sequence of SEQ ID NO: 86. In some embodiments, the COF1/CRBN-binding polypeptide consists of the amino acid sequence of SEQ ID NO: 15. In some embodiments, the COF1/CRBN-binding polypeptide consists of the amino acid sequence of SEQ ID NO: 86.

In some embodiments, the COF1/CRBN-binding polypeptide comprises at least one less lysine than the corresponding native sequence. In some embodiments, one or more lysine residues in the corresponding native sequence are replaced by a different amino acid, e.g., arginine. In some embodiments, the COF1/CRBN-binding polypeptide comprises less than 1, 2, 3, 4, or 5 lysine residues. In some embodiments, the COF1/CRBN-binding polypeptide does not comprise a lysine residue. In some embodiments, the COF1/CRBN-binding polypeptide is not ubiquitinated, e.g., in the presence of COF1, e.g., as measured by an assay described herein, optionally wherein ubiquitination is as measured in a mammalian cell, e.g., a human cell.

In some embodiments, the COF1/CRBN-binding polypeptide comprises an amino acid sequence selected from the group consisting of SEQ ID NOs: 4, 41, 42, and 43. In some embodiments, the COF1/CRBN-binding polypeptide comprises the amino acid sequence of SEQ ID NO: 4. In some embodiments, the COF1/CRBN-binding polypeptide comprises the amino acid sequence of SEQ ID NO: 41. In some embodiments, the COF1/CRBN-binding polypeptide comprises the amino acid sequence of SEQ ID NO: 42. In some embodiments, the COF1/CRBN-binding polypeptide comprises the amino acid sequence of SEQ ID NO: 43.

In some embodiments, the COF1/CRBN-binding polypeptide comprises the amino acid sequence of SEQ ID NO: 2. In some embodiments, the COF1/CRBN-binding polypeptide comprises the amino acid sequence of SEQ ID NO: 4. In some embodiments, the COF1/CRBN-binding polypeptide consists of the amino acid sequence of SEQ ID NO: 2. In some embodiments, the COF1/CRBN-binding polypeptide consists of the amino acid sequence of SEQ ID NO: 4.

In some embodiments, the COF1 is an immunomodulatory imide drug (IMiD), or a pharmaceutically acceptable salt thereof.

In some embodiments, the COF1 has the structure of Formula (I-a):

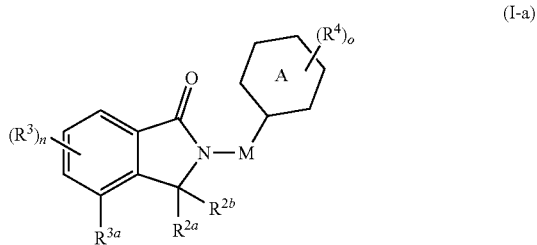

(I-a)

or a pharmaceutically acceptable salt, ester, hydrate, or tautomer thereof, wherein:
Ring A is carbocyclyl, heterocyclyl, aryl, or heteroaryl, each of which is independently and optionally substituted with one or more $R^4$;
M is absent, $C_1$-$C_6$ alkyl, $C_2$-$C_6$ alkenyl, $C_2$-$C_6$ alkynyl, or $C_1$-$C_6$ heteroalkyl, wherein each alkyl, alkenyl, alkynyl, and heteroalkyl is independently and optionally substituted with one or more $R^4$;
each of $R^{2a}$ and $R^{2b}$ is independently hydrogen or $C_1$-$C_6$ alkyl; or $R^{2a}$ and $R^{2b}$ together with the carbon atom to which they are attached to form a carbonyl group or thiocarbonyl group;
$R^{3a}$ is hydrogen, $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)OR$^B$, —OR$^B$, —N(R$^C$)(R$^D$), —C(O)N(R$^C$)(R$^D$), —N(R$^C$)C(O)R$^A$, —S(O)$_x$R$^E$, —S(O)$_x$N(R$^C$)(R$^D$), or —N(R$^C$)S(O)$_x$R$^E$, wherein each alkyl, alkenyl, alkynyl, and heteroalkyl is independently and optionally substituted with one or more $R^6$;
each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)R$^A$, —C(O)OR$^B$, —OR$^B$, —N(R$^C$)(R$^D$), —C(O)N(R$^C$) (R$^D$), —N(R$^C$)C(O)R$^A$, —S(O)$_x$R$^E$, —S(O)$_x$N(R$^C$) (R$^D$), or —N(R$^C$)S(O)$_x$R$^E$, wherein each alkyl, alkenyl, alkynyl, and heteroalkyl is independently and optionally substituted with one or more $R^6$;
each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)R$^A$, —C(O)OR$^B$, —OR$^B$, —N(R$^C$)(R$^D$), —C(O)N(R$^C$)(R$^D$), —N(R$^C$)C(O)R$^A$, S(O)$_x$R$^E$, —S(O)$_x$N(R$^C$)(R$^D$), —N(R$^C$)S(O)$_x$R$^E$, carbocyclyl, heterocyclyl, aryl, or heteroaryl, wherein each alkyl, alkenyl, alkynyl, carbocyclyl, heterocyclyl, aryl, and heteroaryl is independently and optionally substituted with one or more $R^7$;
each of $R^A$, $R^B$, $R^C$, $R^D$, and $R^E$ is independently hydrogen or $C_1$-$C_6$ alkyl;
each $R^6$ is independently $C_1$-$C_6$ alkyl, oxo, cyano, —OR$^B$, —N(R$^C$)(R$^D$), —C(O)N(R$^C$)(R$^D$), —N(R$^C$)C(O)R$^A$, aryl, or heteroaryl, wherein each aryl and heteroaryl is independently and optionally substituted with one or more $R^8$;
each $R^7$ is independently halo, oxo, cyano, —OR$^B$, —N(R$^C$)(R$^D$), —C(O)N(R$^C$)(R$^D$), or —N(R$^C$)C(O)R$^A$;
each $R^8$ is independently $C_1$-$C_6$ alkyl, cyano, —OR$^B$, —N(R$^C$)(R$^D$), —C(O)N(R$^C$)(R$^D$), or —N(R$^C$)C(O)R$^A$;
n is 0, 1, 2, or 3;
o is 0, 1, 2, 3, 4, or 5; and
x is 0, 1, or 2.

In some embodiments of Formula (I-a), X is O. In some embodiments, M is absent. In some embodiments, Ring A is heterocyclyl (e.g., a nitrogen-containing heterocyclyl, e.g., 2-(2,6-dioxopiperidin-3-yl)isoindoline-1,3-dione). In some embodiments, $R^4$ is oxo or OR$^B$ (e.g., —OCH$_3$ or —OCH$_2$CH$_3$) and o is 0, 1, or 2. In some embodiments, each of $R^{2a}$ and $R^{2b}$ is independently hydrogen, or $R^{2a}$ and $R^{2b}$ together with the carbon atom to which they are attached form a carbonyl group. In some embodiments, $R^{3a}$ is heteroalkyl (e.g., —CH$_2$NHC(O)CH$_3$), —N(R$^C$)(R$^D$) (e.g., —NH$_2$), or —N(R$^C$)C(O)R$^A$ (e.g., —NHC(O)CH$_3$). In some embodiments, n is 0.

In some embodiments, the COF1 is thalidomide or analogue, or a pharmaceutically acceptable salt thereof.

In some embodiments, the COF1 is selected from the group consisting of lenalidomide, pomalidomide, thalidomide, and 2-(4-(tert-butyl)phenyl)-N-((2-(2,6-dioxopiperidin-3-yl)-1-oxoisoindolin-5-yl)methyl)acetamide, or a pharmaceutically acceptable salt thereof.

In some embodiments, the COF1 is selected from the group consisting of:

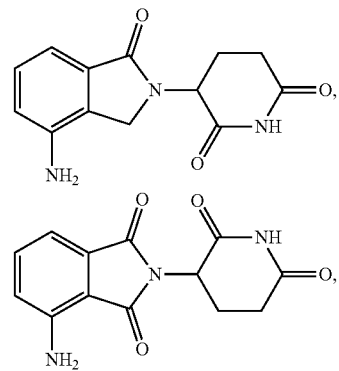

-continued

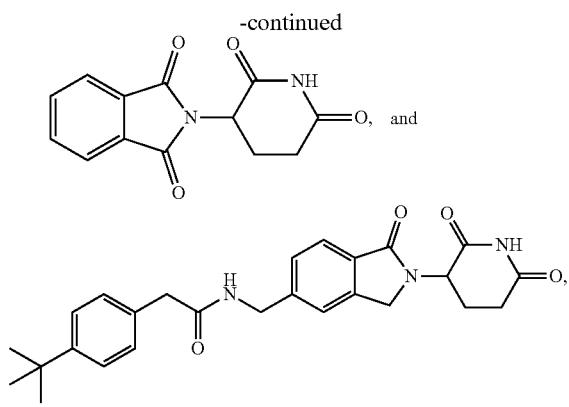

or a pharmaceutically acceptable salt thereof.

In some embodiments, the COF1 is lenalidomide or pomalidomide, or a pharmaceutically acceptable salt thereof. In some embodiments, the COF1 is lenalidomide or analogue, or a pharmaceutically acceptable salt thereof. In some embodiments, the COF1 is lenalidomide, or a pharmaceutically acceptable salt thereof.

In some embodiments, the fusion polypeptide further comprises a degradation domain, wherein the degradation domain is separated from the COF1/CRBN-binding polypeptide and the heterologous polypeptide by a heterologous protease cleavage site.

In some embodiments, the fusion polypeptide comprises, from N-terminus to C-terminus:

i) the degradation domain, the heterologous protease cleavage site, the heterologous polypeptide, and the COF1/CRBN-binding polypeptide;

ii) the degradation domain, the heterologous protease cleavage site, the COF1/CRBN-binding polypeptide, and the heterologous polypeptide;

iii) the COF1/CRBN-binding polypeptide, the heterologous polypeptide, the heterologous protease cleavage site, and the degradation domain; or iv) the heterologous polypeptide, and the COF1/CRBN-binding polypeptide, the heterologous protease cleavage site, and the degradation domain.

In some embodiments, the fusion polypeptide comprises, from N-terminus to C-terminus, the degradation domain, the heterologous protease cleavage site, the heterologous polypeptide, and the COF1/CRBN-binding polypeptide.

In some embodiments, the degradation domain has a first state associated with a first level of expression of the fusion polypeptide and a second state associated with a second level of expression of the fusion polypeptide, wherein the second level is increased, e.g., by at least 2-, 3-, 4-, 5-, 10-, 20- or 30-fold over the first level in the presence of a stabilization compound.

In some embodiments, in the absence of the stabilization compound, the fusion polypeptide is degraded by a cellular degradation pathway, e.g., at least 50%, 60%, 70%, 80%, 90% or greater of the fusion polypeptide is degraded, e.g., as measured by an assay described herein, e.g., a Western blot analysis or a flow cytometry analysis.

In some embodiments, the level of expression, and/or degradation is as measured in a mammalian cell, e.g., a human cell.

In some embodiments, in the presence of the stabilization compound:
i) the degradation domain assumes a conformation more resistant to cellular degradation relative to a conformation in the absence of the stabilization compound; or
ii) the conformation of the fusion polypeptide is more permissive to cleavage at the heterologous protease cleavage site relative to a conformation in the absence of the stabilization compound.

In some embodiments, the degradation domain is chosen from an estrogen receptor (ER) domain, an FKB protein (FKBP) domain, or a dihydrofolate reductase (DHFR) domain.

In some embodiments, the degradation domain is an estrogen receptor (ER) domain. In some embodiments, the degradation domain comprises an amino acid sequence that is at least 90, 95, 97, 98, 99, or 100% identical to SEQ ID NO: 46 or 48. In some embodiments, the degradation domain comprises the amino acid sequence of SEQ ID NO: 46. In some embodiments, the degradation domain comprises the amino acid sequence of SEQ ID NO: 48.

In some embodiments, the stabilization compound is bazedoxifene or 4-hydroxy tamoxifen (4-OHT), or a pharmaceutically acceptable salt thereof. In some embodiments, the degradation domain is an estrogen receptor (ER) domain and the stabilization compound is bazedoxifene, or a pharmaceutically acceptable salt thereof. In some embodiments, the degradation domain comprises the amino acid sequence of SEQ ID NO: 46 and the stabilization compound is bazedoxifene, or a pharmaceutically acceptable salt thereof.

In some embodiments, the degradation domain is an FKB protein (FKBP) domain. In some embodiments, the degradation domain comprises an amino acid sequence that is at least 90, 95, 97, 98, 99, or 100% identical to SEQ ID NO: 50. In some embodiments, the degradation domain comprises the amino acid sequence of SEQ ID NO: 50. In some embodiments, the stabilization compound is Shield-1, or a pharmaceutically acceptable salt thereof.

In some embodiments, the degradation domain is a dihydrofolate reductase (DHFR) domain. In some embodiments, the degradation domain comprises an amino acid sequence that is at least 90, 95, 97, 98, 99, or 100% identical to SEQ ID NO: 51. In some embodiments, the degradation domain comprises the amino acid sequence of SEQ ID NO: 51. In some embodiments, the stabilization compound is trimethoprim, or a pharmaceutically acceptable salt thereof.

In some embodiments, the heterologous protease cleavage site is cleaved by a mammalian intracellular protease. In some embodiments, the heterologous protease cleavage site is cleaved by a protease selected from the group consisting of furin, PCSK1, PCSK5, PCSK6, PCSK7, cathepsin B, Granzyme B, Factor XA, Enterokinase, genenase, sortase, precission protease, thrombin, TEV protease, and elastase 1. In some embodiments, the heterologous protease cleavage site comprises a sequence having a cleavage motif selected from the group consisting of RX(K/R)R consensus motif (X can be any amino acid; SEQ ID NO: 52), RXXX[KR]R consensus motif (X can be any amino acid; SEQ ID NO: 53), RRX consensus motif (SEQ ID NO: 54), I-E-P-D-X consensus motif (SEQ ID NO: 55), Ile-Glu/Asp-Gly-Arg (SEQ ID NO: 56), Asp-Asp-Asp-Asp-Lys (SEQ ID NO: 57), Pro-Gly-Ala-Ala-His-Tyr (SEQ ID NO: 58), LPXTG/A consensus motif (SEQ ID NO: 59), Leu-Glu-Val-Phe-Gln-Gly-Pro (SEQ ID NO: 60), Leu-Val-Pro-Arg-Gly-Ser (SEQ ID NO: 61), E-N-L-Y-F-Q-G (SEQ ID NO: 62), and [AGSV]-X (X can be any amino acid; SEQ ID NO: 63). In some embodiments, the heterologous protease cleavage site is cleaved by furin. In some embodiments, the heterologous protease cleavage site comprises a furin cleavage site selected from the group consisting of RTKR (SEQ ID NO: 123); GTGAEDPRPSRKRRSLGDVG (SEQ ID NO: 125); GTGAEDPRPSRKRR (SEQ ID NO: 127); LQWLEQQ-VAKRRTKR (SEQ ID NO: 129); GTGAE-DPRPSRKRRSLGG (SEQ ID NO: 131); GTGAE-DPRPSRKRRSLG (SEQ ID NO: 133); SLNLTESHNSRKKR (SEQ ID NO: 135); CKINGYPKR-GRKRR (SEQ ID NO: 137); and SARNRQKR (SEQ ID NO: 34). In some embodiments, the heterologous protease cleavage site does not comprise the amino acid sequence of SARNRQKR (SEQ ID NO: 34). In some embodiments, the heterologous protease cleavage site comprises the furin cleavage site of GTGAEDPRPSRKRRSLGDVG (SEQ ID NO: 125). In some embodiments, the heterologous protease cleavage site is cleaved by a mammalian extracellular protease. In some embodiments, the mammalian extracellular protease is selected from the group consisting of Factor XA, Enterokinase, genenase, sortase, precission protease, thrombin, TEV protease, and elastase 1. In some embodiments, the heterologous protease cleavage site comprises an amino acid sequence selected from the group consisting of Ile-Glu/Asp-Gly-Arg (SEQ ID NO: 56), Asp-Asp-Asp-Asp-Lys (SEQ ID NO: 57), Pro-Gly-Ala-Ala-His-Tyr (SEQ ID NO: 58), LPXTG/A consensus motif (SEQ ID NO: 59), Leu-Glu-Val-Phe-Gln-Gly-Pro (SEQ ID NO: 60), Leu-Val-Pro-Arg-Gly-Ser (SEQ ID NO: 61), E-N-L-Y-F-Q-G (SEQ ID NO: 62), and [AGSV]-X (X can be any amino acid; SEQ ID NO: 63).

In one aspect, provided herein is a fusion polypeptide comprising a first domain and a second domain separated by a heterologous protease cleavage site, wherein the first domain comprises a degradation domain and the second domain comprises a compound of Formula (II) (COF2)/CRBN-binding polypeptide and a heterologous polypeptide, e.g., a heterologous mammalian, bacterial, or viral polypeptide, wherein the compound of Formula (II) is:

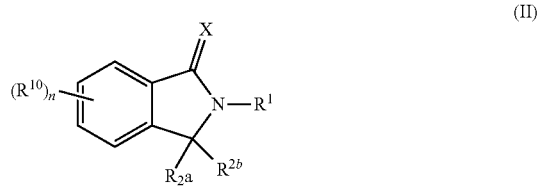

(II)

or a pharmaceutically acceptable salt, ester, hydrate, tautomer, or prodrug thereof, wherein:

X is O or S;

$R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached to form carbonyl group or thiocarbonyl group;

each of $R^{10}$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), or —N($R^C$)S(O)$_x$$R^E$, or L-Tag; wherein each alkyl, alkenyl, alkynyl, and heteroalkyl is independently and optionally substituted with one or more $R^{11}$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, C(O)$R^A$, —C(O)O$R^B$, O$R^B$, —N($R^C$)($R^D$), —C(O)N($R^C$)($R^D$), —N($R^C$)C(O)$R^A$, S(O)$_x$$R^E$, —S(O)$_x$N($R^C$)($R^D$), —N($R^C$)S(O)$_x$$R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^{11}$ is independently $C_1$-$C_6$ alkyl, halo, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with one or more $R^8$;

each $R^7$ is independently halo, oxo, cyano, —O$R^B$, —N($R^C$)($R^D$), —C(O)N($R^C$)($R^D$), or —N($R^C$)C(O)$R^A$;

each $R^8$ is independently $C_1$-$C_6$ alkyl, halo, cyano, —O$R^B$, —N($R^C$)($R^D$), —C(O)N($R^C$)($R^D$), or —N($R^C$)C(O)$R^A$;

each L is independently $C_1$-$C_6$ alkyl, $C_2$-$C_6$ alkenyl, $C_2$-$C_6$ alkynyl, $C_1$-$C_6$ heteroalkyl, —C(O)$R^{A1}$, —C(O)O$R^{B1}$, —O$R^{B1}$, —N($R^{C1}$)($R^{D1}$), —C(O)N($R^{C1}$)($R^{D1}$), —N($R^{C1}$)C(O)$R^{A1}$, —S(O)$_x$$R^{E1}$, —S(O)$_x$N($R^{C1}$)($R^{D1}$), or —N($R^{C1}$)S(O)$_x$$R^{E1}$, wherein each alkyl, alkenyl, alkynyl, and heteroalkyl is independently and optionally substituted with one or more $R^{12}$;

each Tag is a targeting moiety capable of binding to a target protein;

each of $R^{A1}$, $R^{B1}$, $R^{C1}$, $R^{D1}$, and $R^{E1}$ is independently hydrogen, $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^{12}$;

each $R^{12}$ is independently $C_1$-$C_6$ alkyl, halo, cyano, carbocyclyl, or heterocyclyl;

n is 0, 1, 2, 3 or 4; and x is 0, 1, or 2.

In some embodiments, the degradation domain has a first state associated with a first level of expression of the fusion polypeptide and a second state associated with a second level of expression of the fusion polypeptide, wherein the second level is increased, e.g., by at least 2-, 3-, 4-, 5-, 10-, 20- or 30-fold over the first level in the presence of a stabilization compound.

In some embodiments, in the absence of the stabilization compound, the fusion polypeptide is degraded by a cellular degradation pathway, e.g., at least 50%, 60%, 70%, 80%, 90% or greater of the fusion polypeptide is degraded, e.g., as measured by an assay described herein, e.g., a Western blot analysis or a flow cytometry analysis.

In some embodiments, the level of expression, and/or degradation is as measured in a mammalian cell, e.g., a human cell.

In some embodiments, in the presence of the stabilization compound:

i) the degradation domain assumes a conformation more resistant to cellular degradation relative to a conformation in the absence of the stabilization compound; or ii) the conformation of the fusion polypeptide is more permissive to cleavage at the heterologous protease cleavage site relative to a conformation in the absence of the stabilization compound.

In some embodiments, the degradation domain is chosen from an estrogen receptor (ER) domain, an FKB protein (FKBP) domain, or a dihydrofolate reductase (DHFR) domain.

In some embodiments, the degradation domain is an estrogen receptor (ER) domain. In some embodiments, the degradation domain comprises an amino acid sequence that is at least 90, 95, 97, 98, 99, or 100% identical to SEQ ID NO: 46 or 48. In some embodiments, the degradation domain comprises the amino acid sequence of SEQ ID NO: 46. In some embodiments, the degradation domain comprises the amino acid sequence of SEQ ID NO: 48.

In some embodiments, the stabilization compound is bazedoxifene or 4-hydroxy tamoxifen (4-OHT), or a pharmaceutically acceptable salt thereof. In some embodiments, the degradation domain is an estrogen receptor (ER) domain and the stabilization compound is bazedoxifene, or a pharmaceutically acceptable salt thereof. In some embodiments, the degradation domain comprises the amino acid sequence of SEQ ID NO: 46 and the stabilization compound is bazedoxifene, or a pharmaceutically acceptable salt thereof.

In some embodiments, the degradation domain is an FKB protein (FKBP) domain. In some embodiments, the degradation domain comprises an amino acid sequence that is at least 90, 95, 97, 98, 99, or 100% identical to SEQ ID NO: 50. In some embodiments, the degradation domain comprises the amino acid sequence of SEQ ID NO: 50. In some embodiments, the stabilization compound is Shield-1, or a pharmaceutically acceptable salt thereof.

In some embodiments, the degradation domain is a dihydrofolate reductase (DHFR) domain. In some embodiments, the degradation domain comprises an amino acid sequence that is at least 90, 95, 97, 98, 99, or 100% identical to SEQ ID NO: 51. In some embodiments, the degradation domain comprises the amino acid sequence of SEQ ID NO: 51. In some embodiments, the stabilization compound is trimethoprim, or a pharmaceutically acceptable salt thereof.

In some embodiments, the heterologous protease cleavage site is cleaved by a mammalian intracellular protease. In some embodiments, the heterologous protease cleavage site is cleaved by a protease selected from the group consisting of furin, PCSK1, PCSK5, PCSK6, PCSK7, cathepsin B, Granzyme B, Factor XA, Enterokinase, genenase, sortase, precission protease, thrombin, TEV protease, and elastase 1. In some embodiments, the heterologous protease cleavage site comprises a sequence having a cleavage motif selected from the group consisting of RX(K/R)R consensus motif (X can be any amino acid; SEQ ID NO: 52), RXXX[KR]R consensus motif (X can be any amino acid; SEQ ID NO: 53), RRX consensus motif (SEQ ID NO: 54), I-E-P-D-X consensus motif (SEQ ID NO: 55), Ile-Glu/Asp-Gly-Arg (SEQ ID NO: 56), Asp-Asp-Asp-Asp-Lys (SEQ ID NO: 57), Pro-Gly-Ala-Ala-His-Tyr (SEQ ID NO: 58), LPXTG/A consensus motif (SEQ ID NO: 59), Leu-Glu-Val-Phe-Gln-Gly-Pro (SEQ ID NO: 60), Leu-Val-Pro-Arg-Gly-Ser (SEQ ID NO: 61), E-N-L-Y-F-Q-G (SEQ ID NO: 62), and [AGSV]-X (X can be any amino acid; SEQ ID NO: 63). In some embodiments, the heterologous protease cleavage site is cleaved by furin. In some embodiments, the heterologous protease cleavage site comprises a furin cleavage site selected from the group consisting of RTKR (SEQ ID NO: 123); GTGAEDPRPSRKRRSLGDVG (SEQ ID NO: 125); GTGAEDPRPSRKRR (SEQ ID NO: 127); LQWLEQQ-VAKRRTKR (SEQ ID NO: 129); GTGAE-DPRPSRKRRSLGG (SEQ ID NO: 131); GTGAE-DPRPSRKRRSLG (SEQ ID NO: 133); SLNLTESHNSRKKR (SEQ ID NO: 135); CKINGYPKR-GRKRR (SEQ ID NO: 137); and SARNRQKR (SEQ ID NO: 34). In some embodiments, the heterologous protease cleavage site does not comprise the amino acid sequence of SARNRQKR (SEQ ID NO: 34). In some embodiments, the heterologous protease cleavage site comprises the furin cleavage site of GTGAEDPRPSRKRRSLGDVG (SEQ ID NO: 125). In some embodiments, the heterologous protease cleavage site is cleaved by a mammalian extracellular protease. In some embodiments, the mammalian extracellular protease is selected from the group consisting of Factor XA, Enterokinase, genenase, sortase, precission protease, thrombin, TEV protease, and elastase 1. In some embodiments, the heterologous protease cleavage site comprises an amino acid sequence selected from the group consisting of Ile-Glu/Asp-Gly-Arg (SEQ ID NO: 56), Asp-Asp-Asp-Asp-Lys (SEQ ID NO: 57), Pro-Gly-Ala-Ala-His-Tyr (SEQ ID NO: 58), LPXTG/A consensus motif (SEQ ID NO: 59), Leu-Glu-Val-Phe-Gln-Gly-Pro (SEQ ID NO: 60), Leu-Val-Pro-Arg-Gly-Ser (SEQ ID NO: 61), E-N-L-Y-F-Q-G (SEQ ID NO: 62), and [AGSV]-X (X can be any amino acid; SEQ ID NO: 63).

In some embodiments, the degradation domain is fused to the heterologous protease cleavage site, which is further fused to the second domain.

In some embodiments, the fusion polypeptide comprises, from N-terminus to C-terminus:
i) the degradation domain, the heterologous protease cleavage site, the heterologous polypeptide, and the COF2/CRBN-binding polypeptide;
ii) the degradation domain, the heterologous protease cleavage site, the COF2/CRBN-binding polypeptide, and the heterologous polypeptide;
iii) the COF2/CRBN-binding polypeptide, the heterologous polypeptide, the heterologous protease cleavage site, and the degradation domain; or
iv) the heterologous polypeptide, and the COF2/CRBN-binding polypeptide, the heterologous protease cleavage site, and the degradation domain.

In some embodiments, the fusion polypeptide comprises, from N-terminus to C-terminus, the degradation domain, the heterologous protease cleavage site, the heterologous polypeptide, and the COF2/CRBN-binding polypeptide. In some embodiments, the fusion polypeptide comprises, from N-terminus to C-terminus, the degradation domain, the heterologous protease cleavage site, the COF2/CRBN-binding polypeptide, and the heterologous polypeptide. In some embodiments, the fusion polypeptide comprises, from N-terminus to C-terminus, the COF2/CRBN-binding polypeptide, the heterologous polypeptide, the heterologous protease cleavage site, and the degradation domain. In some embodiments, the fusion polypeptide comprises, from N-terminus to C-terminus, the heterologous polypeptide, and the COF2/CRBN-binding polypeptide, the heterologous protease cleavage site, and the degradation domain.

In some embodiments, the association of the COF2/CRBN-binding polypeptide with cereblon (CRBN) in the absence of COF2 is no more than, e.g., 0.01%, 0.1%, 1%, 5%, 10%, 15%, or 20%, of the association of the COF2/CRBN-binding polypeptide with CRBN in the presence of COF2, e.g., an excess of COF2, e.g., as measured by an assay described herein, e.g., immunoprecipitation. In some embodiments, the COF2/CRBN-binding polypeptide does not bind to CRBN in the absence of COF2. In some embodiments, the association of the fusion polypeptide with CRBN in the absence of COF2 is no more than, e.g., 0.01%, 0.1%, 1%, 5%, 10%, 15%, or 20%, of the association of the fusion polypeptide with CRBN in the presence of COF2, e.g., an excess of COF2, e.g., as measured by an assay described herein, e.g., immunoprecipitation. In some embodiments, the fusion polypeptide does not bind to CRBN in the absence of COF2. In some embodiments, the association and/or binding is as measured in a mammalian cell, e.g., a human cell.

In some embodiments, the ubiquitination of the heterologous polypeptide in the absence of COF2 is no more than, e.g., 0.01%, 0.1%, 1%, 10%, 20%, 30%, 40%, 50%, 60%, or 70%, of the ubiquitination of the heterologous polypeptide in the presence of COF2, e.g., an excess of COF2, e.g., as measured by an assay described herein. In some embodiments, the ubiquitination of the fusion polypeptide in the absence of COF2 is no more than, e.g., 0.01%, 0.1%, 1%, 10%, 20%, 30%, 40%, 50%, 60%, or 70%, of the ubiquitination of the fusion polypeptide in the presence of COF2, e.g., an excess of COF2, e.g., as measured by an assay described herein. In some embodiments, the heterologous polypeptide or the fusion polypeptide is ubiquitinated at one or more lysine or methionine residues in the presence of COF2. In some embodiments, the ubiquitination is as measured in a mammalian cell, e.g., a human cell.

In some embodiments, the degradation of the fusion polypeptide in the absence of COF2 is no more than, e.g., 0.01%, 0.1%, 1%, 10%, 20%, 30%, 40%, 50%, 60%, or 70%, of the degradation of the fusion polypeptide in the presence of COF2, e.g., an excess of COF2, e.g., as measured by an assay described herein, e.g., a Western blot analysis or a flow cytometry analysis. In some embodiments, the degradation of the fusion polypeptide is mediated by ubiquitination in the presence of COF2. In some embodiments, the degradation is as measured in a mammalian cell, e.g., a human cell.

In some embodiments, the COF2/CRBN-binding polypeptide is between 10 and 95 amino acid residues in length, between 15 and 90 amino acid residues in length, between 20 and 85 amino acid residues in length, between 25 and 80 amino acid residues in length, between 30 and 75 amino acid residues in length, between 35 and 70 amino acid residues in length, between 40 and 65 amino acid residues in length, between 45 and 65 amino acid residues in length, between 50 and 65 amino acid residues in length, or between 55 and 65 amino acid residues in length.

In some embodiments, the COF2/CRBN-binding polypeptide comprises a beta turn. In some embodiments, the COF2/CRBN-binding polypeptide comprises a beta turn of IKZF1 or IKZF3 (e.g., human IKZF1 or IKZF3). In some embodiments, the COF2/CRBN-binding polypeptide comprises a beta hairpin. In some embodiments, the COF2/CRBN-binding polypeptide comprises a beta hairpin of IKZF1 or IKZF3 (e.g., human IKZF1 or IKZF3). In some embodiments, the COF2/CRBN-binding polypeptide comprises a beta strand. In some embodiments, the COF2/CRBN-binding polypeptide comprises a beta strand of IKZF1 or IKZF3 (e.g., human IKZF1 or IKZF3). In some embodiments, the COF2/CRBN-binding polypeptide comprises an alpha helix. In some embodiments, the COF2/CRBN-binding polypeptide comprises an alpha helix of IKZF1 or IKZF3 (e.g., human IKZF1 or IKZF3). In some embodiments, the COF2/CRBN-binding polypeptide comprises, from N-terminus to C-terminus, a first beta strand, a beta hairpin, a second beta strand, and a first alpha helix. In some embodiments, the COF2/CRBN-binding polypeptide comprises, from N-terminus to C-terminus, a first beta strand, a beta hairpin, a second beta strand, and a first alpha helix of IKZF1 or IKZF3 (e.g., human IKZF1 or IKZF3). In some embodiments, the COF2/CRBN-binding polypeptide comprises, from N-terminus to C-terminus, a first beta strand, a beta hairpin, a second beta strand, a first alpha helix, and a second alpha helix. In some embodiments, the COF2/CRBN-binding polypeptide comprises, from N-terminus to C-terminus, a first beta strand, a beta hairpin, a second beta strand, a first alpha helix, and a second alpha helix of IKZF1 or IKZF3 (e.g., human IKZF1 or IKZF3). In some embodiments, the beta hairpin and the second alpha helix are separated by no more than 60, 50, 40, or 30 amino acid residues.

In some embodiments, the COF2/CRBN-binding polypeptide comprises a COF2/CRBN-binding sequence from a naturally occurring polypeptide or a COF2/CRBN-binding variant thereof. In some embodiments, the COF2/CRBN-binding polypeptide comprises a COF2/CRBN-binding sequence from a naturally occurring IKZF polypeptide or a COF2/CRBN-binding variant thereof. In some embodiments, the COF2/CRBN-binding polypeptide comprises a COF2/CRBN-binding sequence from a naturally occurring IKZF1, IKZF2, IKZF3, IKZF4, or IKZF5, or a COF2/CRBN-binding variant thereof. In some embodiments, the COF2/CRBN-binding sequence comprises two or more discontinuous sequences from the naturally occurring polypeptide, e.g., a naturally occurring IKZF polypeptide, e.g., a naturally occurring IKZF1, IKZF2, IKZF3, IKZF4, or IKZF5.

In some embodiments, the COF2/CRBN-binding polypeptide comprises an IKZF polypeptide or a structural motif thereof.

In some embodiments, the IKZF polypeptide is an IKZF1 polypeptide, an IKZF3 polypeptide, an IKZF2 polypeptide having H141Q substitution (numbered according to SEQ ID NO: 21), or an IKZF4 polypeptide having H188Q substitution (numbered according to SEQ ID NO: 22).

In some embodiments, the COF2/CRBN-binding polypeptide comprises sufficient amino acid sequence and/or a structural motif from IKZF (e.g., IKZF1 or IKZF3) that:
  i) the association of the COF2/CRBN-binding polypeptide with CRBN in the absence of COF2 is no more than, e.g., 0.01%, 0.1%, 1%, 5%, 10%, 15%, or 20%, of the association of the COF2/CRBN-binding polypeptide with CRBN in the presence of COF2, e.g., an excess of COF2, e.g., as measured by an assay described herein, e.g., immunoprecipitation;
  ii) the association of the fusion polypeptide with CRBN in the absence of COF2 is no more than, e.g., 0.01%, 0.1%, 1%, 5%, 10%, 15%, or 20% of the association of the fusion polypeptide with CRBN in the presence of COF2, e.g., an excess of COF2, e.g., as measured by an assay described herein, e.g., immunoprecipitation;
  iii) the ubiquitination of the heterologous polypeptide in the absence of COF2 is no more than, e.g., 0.01%, 0.1%, 1%, 10%, 20%, 30%, 40%, 50%, 60%, or 70%, of the ubiquitination of the heterologous polypeptide in the presence of COF2, e.g., an excess of COF2, e.g., as measured by an assay described herein;
  iv) the ubiquitination of the fusion polypeptide in the absence of COF2 is no more than, e.g., 0.01%, 0.1%, 1%, 10%, 20%, 30%, 40%, 50%, 60%, or 70%, of the ubiquitination of the fusion polypeptide in the presence of COF2, e.g., an excess of COF2, e.g., as measured by an assay described herein; or
  v) the degradation of the fusion polypeptide in the absence of COF2 is no more than, e.g., 0.01%, 0.1%, 1%, 10%, 20%, 30%, 40%, 50%, 60%, or 70%, of the degradation of the fusion polypeptide in the presence of COF2, e.g., an excess of COF2, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF2/CRBN-binding polypeptide comprises about 10 to about 95 amino acid residues, about 15 to about 90 amino acid residues, about 20 to about 85 amino acid residues, about 25 to about 80 amino acid residues, about 30 to about 75 amino acid residues, about 35 to about 70 amino acid residues, about 40 to about 65 amino acid residues, about 45 to about 65 amino acid residues, about 50 to about 65 amino acid residues, or about 55 to about 65 amino acid residues of IKZF1 or IKZF3.

In some embodiments, the COF2/CRBN-binding polypeptide comprises sufficient amino acid sequence and/or a structural motif from amino acid residues 136-180 of IKZF3 (numbered according to SEQ ID NO: 19) (e.g., sufficient amino acid sequence and/or a structural motif from amino acid residues 136-180 of SEQ ID NO: 19) that:
i) the association of the COF2/CRBN-binding polypeptide with CRBN in the absence of COF2 is no more than, e.g., 0.01%, 0.1%, 1%, 5%, 10%, 15%, or 20%, of the association of the COF2/CRBN-binding polypeptide with CRBN in the presence of COF2, e.g., an excess of COF2, e.g., as measured by an assay described herein, e.g., immunoprecipitation;
ii) the association of the fusion polypeptide with CRBN in the absence of COF2 is no more than, e.g., 0.01%, 0.1%, 1%, 5%, 10%, 15%, or 20% of the association of the fusion polypeptide with CRBN in the presence of COF2, e.g., an excess of COF2, e.g., as measured by an assay described herein, e.g., immunoprecipitation;
iii) the ubiquitination of the heterologous polypeptide in the absence of COF2 is no more than, e.g., 0.01%, 0.1%, 1%, 10%, 20%, 30%, 40%, 50%, 60%, or 70%, of the ubiquitination of the heterologous polypeptide in the presence of COF2, e.g., an excess of COF2, e.g., as measured by an assay described herein;
iv) the ubiquitination of the fusion polypeptide in the absence of COF2 is no more than, e.g., 0.01%, 0.1%, 1%, 10%, 20%, 30%, 40%, 50%, 60%, or 70%, of the ubiquitination of the fusion polypeptide in the presence of COF2, e.g., an excess of COF2, e.g., as measured by an assay described herein; or
v) the degradation of the fusion polypeptide in the absence of COF2 is no more than, e.g., 0.01%, 0.1%, 1%, 10%, 20%, 30%, 40%, 50%, 60%, or 70%, of the degradation of the fusion polypeptide in the presence of COF2, e.g., an excess of COF2, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF2/CRBN-binding polypeptide comprises amino acid residues 136-180 of IKZF3 (numbered according to SEQ ID NO: 19) (e.g., the COF2/CRBN-binding polypeptide comprises the amino acid sequence of SEQ ID NO: 5) or a sequence that differs from amino acid residues 136-180 of IKZF3 (numbered according to SEQ ID NO: 19) by no more than 1, 2, 3, 4, 5, 10, 15, 20, 25, 30, 35, or 40 amino acid residues (e.g., a sequence that differs from amino acid residues 136-180 of SEQ ID NO: 19 by no more than 1, 2, 3, 4, 5, 10, 15, 20, 25, 30, 35, or 40 amino acid residues) (e.g., a sequence having no more than 1, 2, 3, 4, 5, 10, 15, 20, 25, 30, 35, or 40 amino acid substitutions from amino acid residues 136-180 of SEQ ID NO: 19).

In some embodiments, the COF2/CRBN-binding polypeptide comprises sufficient amino acid sequence and/or a structural motif from amino acid residues 136-170 of IKZF3 (numbered according to SEQ ID NO: 19) (e.g., sufficient amino acid sequence and/or a structural motif from amino acid residues 136-170 of SEQ ID NO: 19) that:
i) the association of the COF2/CRBN-binding polypeptide with CRBN in the absence of COF2 is no more than, e.g., 0.01%, 0.1%, 1%, 5%, 10%, 15%, or 20%, of the association of the COF2/CRBN-binding polypeptide with CRBN in the presence of COF2, e.g., an excess of COF2, e.g., as measured by an assay described herein, e.g., immunoprecipitation;
ii) the association of the fusion polypeptide with CRBN in the absence of COF2 is no more than, e.g., 0.01%, 0.1%, 1%, 5%, 10%, 15%, or 20% of the association of the fusion polypeptide with CRBN in the presence of COF2, e.g., an excess of COF2, e.g., as measured by an assay described herein, e.g., immunoprecipitation;
iii) the ubiquitination of the heterologous polypeptide in the absence of COF2 is no more than, e.g., 0.01%, 0.1%, 1%, 10%, 20%, 30%, 40%, 50%, 60%, or 70%, of the ubiquitination of the heterologous polypeptide in the presence of COF2, e.g., an excess of COF2, e.g., as measured by an assay described herein;
iv) the ubiquitination of the fusion polypeptide in the absence of COF2 is no more than, e.g., 0.01%, 0.1%, 1%, 10%, 20%, 30%, 40%, 50%, 60%, or 70%, of the ubiquitination of the fusion polypeptide in the presence of COF2, e.g., an excess of COF2, e.g., as measured by an assay described herein; or
v) the degradation of the fusion polypeptide in the absence of COF2 is no more than, e.g., 0.01%, 0.1%, 1%, 10%, 20%, 30%, 40%, 50%, 60%, or 70%, of the degradation of the fusion polypeptide in the presence of COF2, e.g., an excess of COF2, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF2/CRBN-binding polypeptide comprises amino acid residues 136-170 of IKZF3 (numbered according to SEQ ID NO: 19) (e.g., the COF2/CRBN-binding polypeptide comprises the amino acid sequence of SEQ ID NO: 6) or a sequence that differs from amino acid residues 136-170 of IKZF3 (numbered according to SEQ ID NO: 19) by no more than 1, 2, 3, 4, 5, 10, 15, 20, 25, or 30 amino acid residues (e.g., a sequence that differs from amino acid residues 136-170 of SEQ ID NO: 19 by no more than 1, 2, 3, 4, 5, 10, 15, 20, 25, or 30 amino acid residues) (e.g., a sequence having no more than 1, 2, 3, 4, 5, 10, 15, 20, 25, or 30 amino acid substitutions from amino acid residues 136-170 of SEQ ID NO: 19).

In some embodiments, one, two, three or all of the following amino acid residues remain unaltered: glutamine at position 147, cysteine at position 148, glutamine at position 150, glycine at position 152, leucine at position 161, or leucine at position 162, numbered according to SEQ ID NO: 19. In some embodiments, glutamine at position 147 remains unaltered, numbered according to SEQ ID NO: 19. In some embodiments, cysteine at position 148 remains unaltered, numbered according to SEQ ID NO: 19. In some embodiments, glutamine at position 150 remains unaltered, numbered according to SEQ ID NO: 19. In some embodiments, glycine at position 152 remains unaltered, numbered according to SEQ ID NO: 19. In some embodiments, leucine at position 161 remains unaltered, numbered according to SEQ ID NO: 19. In some embodiments, leucine at position 162 remains unaltered, numbered according to SEQ ID NO: 19.

In some embodiments, the COF2/CRBN-binding polypeptide comprises amino acid residues 136-139 of IKZF3 (numbered according to SEQ ID NO: 19), e.g., the COF2/CRBN-binding polypeptide comprises the amino acid sequence of SEQ ID NO: 40.

In some embodiments, the COF2/CRBN-binding polypeptide comprises amino acid residues 136-180 of IKZF3 (numbered according to SEQ ID NO: 19). In some embodiments, the COF2/CRBN-binding polypeptide comprises the amino acid sequence of SEQ ID NO: 5. In some embodiments, the COF2/CRBN-binding polypeptide comprises the amino acid sequence of SEQ ID NO: 77. In some embodiments, the COF2/CRBN-binding polypeptide consists of the amino acid sequence of SEQ ID NO: 5. In some embodiments, the COF2/CRBN-binding polypeptide consists of the amino acid sequence of SEQ ID NO: 5.

In some embodiments, the COF2/CRBN-binding polypeptide comprises amino acid residues 136-170 of IKZF3 (numbered according to SEQ ID NO: 19). In some embodiments, the COF2/CRBN-binding polypeptide comprises the amino acid sequence of SEQ ID NO: 6. In some embodiments, the COF2/CRBN-binding polypeptide comprises the amino acid sequence of SEQ ID NO: 78. In some embodiments, the COF2/CRBN-binding polypeptide consists of the amino acid sequence of SEQ ID NO: 6. In some embodiments, the COF2/CRBN-binding polypeptide consists of the amino acid sequence of SEQ ID NO: 78.

In some embodiments, the COF2/CRBN-binding polypeptide comprises sufficient amino acid sequence and/or a structural motif from amino acid residues 236-249 of IKZF3 (numbered according to SEQ ID NO: 19) (e.g., sufficient amino acid sequence and/or a structural motif from amino acid residues 236-249 of SEQ ID NO: 19) that:
i) the association of the COF2/CRBN-binding polypeptide with CRBN in the absence of COF2 is no more than, e.g., 0.01%, 0.1%, 1%, 5%, 10%, 15%, or 20%, of the association of the COF2/CRBN-binding polypeptide with CRBN in the presence of COF2, e.g., an excess of COF2, e.g., as measured by an assay described herein, e.g., immunoprecipitation;
ii) the association of the fusion polypeptide with CRBN in the absence of COF2 is no more than, e.g., 0.01%, 0.1%, 1%, 5%, 10%, 15%, or 20% of the association of the fusion polypeptide with CRBN in the presence of COF2, e.g., an excess of COF2, e.g., as measured by an assay described herein, e.g., immunoprecipitation;
iii) the ubiquitination of the heterologous polypeptide in the absence of COF2 is no more than, e.g., 0.01%, 0.1%, 1%, 10%, 20%, 30%, 40%, 50%, 60%, or 70%, of the ubiquitination of the heterologous polypeptide in the presence of COF2, e.g., an excess of COF2, e.g., as measured by an assay described herein;
iv) the ubiquitination of the fusion polypeptide in the absence of COF2 is no more than, e.g., 0.01%, 0.1%, 1%, 10%, 20%, 30%, 40%, 50%, 60%, or 70%, of the ubiquitination of the fusion polypeptide in the presence of COF2, e.g., an excess of COF2, e.g., as measured by an assay described herein; or
v) the degradation of the fusion polypeptide in the absence of COF2 is no more than, e.g., 0.01%, 0.1%, 1%, 10%, 20%, 30%, 40%, 50%, 60%, or 70%, of the degradation of the fusion polypeptide in the presence of COF2, e.g., an excess of COF2, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF2/CRBN-binding polypeptide comprises amino acid residues 236-249 of IKZF3 (numbered according to SEQ ID NO: 19) (e.g., the COF2/CRBN-binding polypeptide comprises the amino acid sequence of SEQ ID NO: 11) or a sequence that differs from amino acid residues 236-249 of IKZF3 (numbered according to SEQ ID NO: 19) by no more than 1, 2, 3, 4, 5, 6, or 7 amino acid residues (e.g., a sequence that differs from amino acid residues 236-249 of SEQ ID NO: 19 by no more than 1, 2, 3, 4, 5, 6, or 7 amino acid residues) (e.g., a sequence having no more than 1, 2, 3, 4, 5, 6, or 7 amino acid substitutions from amino acid residues 236-249 of SEQ ID NO: 19).

In some embodiments, the COF2/CRBN-binding polypeptide comprises amino acid residues 236-249 of IKZF3 (numbered according to SEQ ID NO: 19). In some embodiments, the COF2/CRBN-binding polypeptide comprises the amino acid sequence of SEQ ID NO: 11.

In some embodiments, the COF2/CRBN-binding polypeptide comprises the amino acid sequence of SEQ ID NO: 91.

In some embodiments, the COF2/CRBN-binding polypeptide comprises sufficient amino acid sequence and/or a structural motif from amino acid residues 136-180 and 236-249 of IKZF3 (numbered according to SEQ ID NO: 19) (e.g., sufficient amino acid sequence and/or a structural motif from amino acid residues 136-180 and 236-249 of SEQ ID NO: 19) that:
i) the association of the COF2/CRBN-binding polypeptide with CRBN in the absence of COF2 is no more than, e.g., 0.01%, 0.1%, 1%, 5%, 10%, 15%, or 20%, of the association of the COF2/CRBN-binding polypeptide with CRBN in the presence of COF2, e.g., an excess of COF2, e.g., as measured by an assay described herein, e.g., immunoprecipitation;
ii) the association of the fusion polypeptide with CRBN in the absence of COF2 is no more than, e.g., 0.01%, 0.1%, 1%, 5%, 10%, 15%, or 20% of the association of the fusion polypeptide with CRBN in the presence of COF2, e.g., an excess of COF2, e.g., as measured by an assay described herein, e.g., immunoprecipitation;
iii) the ubiquitination of the heterologous polypeptide in the absence of COF2 is no more than, e.g., 0.01%, 0.1%, 1%, 10%, 20%, 30%, 40%, 50%, 60%, or 70%, of the ubiquitination of the heterologous polypeptide in the presence of COF2, e.g., an excess of COF2, e.g., as measured by an assay described herein;
iv) the ubiquitination of the fusion polypeptide in the absence of COF2 is no more than, e.g., 0.01%, 0.1%, 1%, 10%, 20%, 30%, 40%, 50%, 60%, or 70%, of the ubiquitination of the fusion polypeptide in the presence of COF2, e.g., an excess of COF2, e.g., as measured by an assay described herein; or
v) the degradation of the fusion polypeptide in the absence of COF2 is no more than, e.g., 0.01%, 0.1%, 1%, 10%, 20%, 30%, 40%, 50%, 60%, or 70%, of the degradation of the fusion polypeptide in the presence of COF2, e.g., an excess of COF2, e.g., as measured by an assay described herein, e.g., a Western blot analysis or a flow cytometry analysis.

In some embodiments, the association, ubiquitination, and/or degradation is as measured in a mammalian cell, e.g., a human cell.

In some embodiments, the COF2/CRBN-binding polypeptide comprises a first sequence comprising amino acid residues 136-180 of IKZF3 (numbered according to SEQ ID NO: 19) (e.g., a first sequence comprising the amino acid sequence of SEQ ID NO: 5) or a first sequence that differs from amino acid residues 136-180 of IKZF3 (numbered according to SEQ ID NO: 19) by no more than 1, 2, 3, 4, 5, 10, 15, 20, 25, 30, 35, or 40 amino acid residues (e.g., a first sequence that differs from amino acid residues 136-180 of SEQ ID NO: 19 by no more than 1, 2, 3, 4, 5, 10, 15, 20, 25, 30, 35, or 40 amino acid residues); and a second sequence comprising amino acid residues 236-249 of IKZF3 (numbered according to SEQ ID NO: 19) (e.g., a second sequence comprising the amino acid sequence of SEQ ID NO: 11) or a second sequence that differs from amino acid residues 236-249 of IKZF3 (numbered according to SEQ ID NO: 19) by no more than 1, 2, 3, 4, 5, 6, or 7 amino acid residues (e.g., a second sequence that differs from amino acid residues 236-249 of SEQ ID NO: 19 by no more than 1, 2, 3, 4, 5, 6, or 7 amino acid residues).

In some embodiments, the COF2/CRBN-binding polypeptide comprises amino acid residues 136-180 and 236-249 of IKZF3 (numbered according to SEQ ID NO: 19). In some embodiments, the COF2/CRBN-binding polypeptide comprises the amino acid sequence of SEQ ID NO: 1. In some embodiments, the COF2/CRBN-binding polypeptide comprises the amino acid sequence of SEQ ID NO: 3. In some embodiments, the COF2/CRBN-binding polypeptide consists of the amino acid sequence of SEQ ID NO: 1. In some embodiments, the COF2/CRBN-binding polypeptide consists of the amino acid sequence of SEQ ID NO: 3.

In some embodiments, the COF2/CRBN-binding polypeptide comprises a first sequence comprising amino acid residues 136-180 of IKZF3 (numbered according to SEQ ID NO: 19) and a second sequence comprising the amino acid sequence of MALEKMALEKMALE (SEQ ID NO: 91). In some embodiments, the COF2/CRBN-binding polypeptide comprises the amino acid sequence of SEQ ID NO: 14. In some embodiments, the COF2/CRBN-binding polypeptide comprises the amino acid sequence of SEQ ID NO: 85. In some embodiments, the COF2/CRBN-binding polypeptide consists of the amino acid sequence of SEQ ID NO: 14. In some embodiments, the COF2/CRBN-binding polypeptide consists of the amino acid sequence of SEQ ID NO: 85.

In some embodiments, the COF2/CRBN-binding polypeptide comprises a first sequence comprising amino acid residues 136-170 of IKZF3 (numbered according to SEQ ID NO: 19) and a second sequence comprising the amino acid sequence of MALEKMALEKMALE (SEQ ID NO: 91). In some embodiments, the COF2/CRBN-binding polypeptide comprises the amino acid sequence of SEQ ID NO: 15. In some embodiments, the COF2/CRBN-binding polypeptide comprises the amino acid sequence of SEQ ID NO: 86. In some embodiments, the COF2/CRBN-binding polypeptide consists of the amino acid sequence of SEQ ID NO: 15. In some embodiments, the COF2/CRBN-binding polypeptide consists of the amino acid sequence of SEQ ID NO: 86.

In some embodiments, the COF2/CRBN-binding polypeptide comprises at least one less lysine than the corresponding native sequence. In some embodiments, one or more lysine residues in the corresponding native sequence are replaced by a different amino acid, e.g., arginine. In some embodiments, the COF2/CRBN-binding polypeptide comprises less than 1, 2, 3, 4, or 5 lysine residues.

In some embodiments, the COF2/CRBN-binding polypeptide does not comprise a lysine residue. In some embodiments, the COF2/CRBN-binding polypeptide is not ubiquitinated, e.g., in the presence of COF2, e.g., as measured by an assay described herein, optionally wherein ubiquitination is as measured in a mammalian cell, e.g., a human cell.

In some embodiments, the COF2/CRBN-binding polypeptide comprises an amino acid sequence selected from the group consisting of SEQ ID NOs: 4, 41, 42, and 43. In some embodiments, the COF2/CRBN-binding polypeptide comprises the amino acid sequence of SEQ ID NO: 4. In some embodiments, the COF2/CRBN-binding polypeptide comprises the amino acid sequence of SEQ ID NO: 41. In some embodiments, the COF2/CRBN-binding polypeptide comprises the amino acid sequence of SEQ ID NO: 42. In some embodiments, the COF2/CRBN-binding polypeptide comprises the amino acid sequence of SEQ ID NO: 43.

In some embodiments, the COF2/CRBN-binding polypeptide comprises the amino acid sequence of SEQ ID NO: 2. In some embodiments, the COF2/CRBN-binding polypeptide comprises the amino acid sequence of SEQ ID NO: 4. In some embodiments, the COF2/CRBN-binding polypeptide consists of the amino acid sequence of SEQ ID NO: 2. In some embodiments, the COF2/CRBN-binding polypeptide consists of the amino acid sequence of SEQ ID NO: 4.

In some embodiments, the COF2 is an immunomodulatory imide drug (IMiD), or a pharmaceutically acceptable salt thereof.

In some embodiments, the COF2 has the structure of Formula (I):

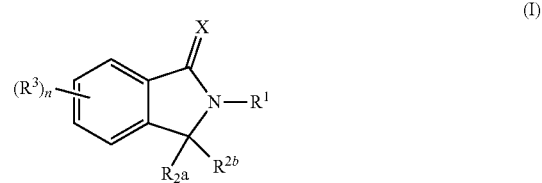

(I)

or a pharmaceutically acceptable salt, ester, hydrate, solvate, or tautomer thereof, wherein:

X is O or S;

$R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached form a carbonyl group or a thiocarbonyl group;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)$_x$N($R^C$)($R^D$), or —N($R^C$)S(O)$_x R^E$, wherein each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)$_x$N($R^C$)($R^D$), —N($R^C$)S(O)$_x R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^6$ is independently $C_1$-$C_6$ alkyl, oxo, cyano, —$OR^B$, —$N(R^C)(R^D)$, —$C(O)N(R^C)(R^D)$, —$N(R^C)C(O)R^A$, aryl, or heteroaryl, wherein each aryl and heteroaryl is independently and optionally substituted with one or more $R^8$;

each $R^7$ is independently halo, oxo, cyano, —$OR^B$, —$N(R^C)(R^D)$, —$C(O)N(R^C)(R^D)$, or —$N(R^C)C(O)R^A$;

each $R^8$ is independently $C_1$-$C_6$ alkyl, cyano, —$OR^B$, —$N(R^C)(R^D)$, —$C(O)N(R^C)(R^D)$, or —$N(R^C)C(O)R^A$;

n is 0, 1, 2, 3 or 4; and x is 0, 1, or 2.

In some embodiments, the COF2 has the structure of Formula (I-a):

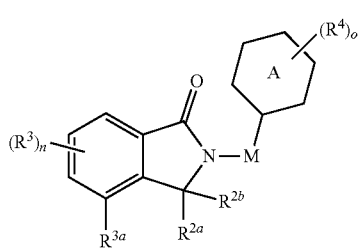

(I-a)

or a pharmaceutically acceptable salt, ester, hydrate, or tautomer thereof, wherein:

Ring A is carbocyclyl, heterocyclyl, aryl, or heteroaryl, each of which is independently and optionally substituted with one or more $R^4$;

M is absent, $C_1$-$C_6$ alkyl, $C_2$-$C_6$ alkenyl, $C_2$-$C_6$ alkynyl, or $C_1$-$C_6$ heteroalkyl, wherein each alkyl, alkenyl, alkynyl, and heteroalkyl is independently and optionally substituted with one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached to form a carbonyl group or thiocarbonyl group;

$R^{3a}$ is hydrogen, $C_1$-$C_6$ alkyl, $C_2$-$C_6$ alkenyl, $C_2$-$C_6$ alkynyl, $C_1$-$C_6$ heteroalkyl, halo, cyano, —$C(O)R^A$, —$C(O)OR^B$, —$OR^B$, —$N(R^C)(R^D)$, —$C(O)N(R^C)(R^D)$, —$N(R^C)C(O)R^A$, —$S(O)_xR^E$, —$S(O)$—$N(R^C)(R^D)$, or —$N(R^C)S(O)_xR^E$, wherein each alkyl, alkenyl, alkynyl, and heteroalkyl is independently and optionally substituted with one or more $R^6$;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —$C(O)R^A$, —$C(O)OR^B$, —$OR^B$, —$N(R^C)(R^D)$, —$C(O)N(R^C)(R^D)$, —$N(R^C)C(O)R^A$, —$S(O)_xR^E$, —$S(O)_xN(R^C)(R^D)$, or —$N(R^C)S(O)_xR^E$, wherein each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —$C(O)R^A$, —$C(O)OR^B$, —$OR^B$, —$N(R^C)(R^D)$, —$C(O)N(R^C)(R^D)$, —$N(R^C)C(O)R^A$, —$S(O)_xR^E$, —$S(O)_xN(R^C)(R^D)$, —$N(R^C)S(O)_xR^E$, carbocyclyl, heterocyclyl, aryl, or heteroaryl, wherein each alkyl, alkenyl, alkynyl, carbocyclyl, heterocyclyl, aryl, and heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^6$ is independently $C_1$-$C_6$ alkyl, oxo, cyano, —$OR^B$, —$N(R^C)(R^D)$, —$C(O)N(R^C)(R^D)$, —$N(R^C)C(O)R^A$, aryl, or heteroaryl, wherein each aryl and heteroaryl is independently and optionally substituted with one or more $R^8$;

each $R^7$ is independently halo, oxo, cyano, —$OR^B$, —$N(R^C)(R^D)$, —$C(O)N(R^C)(R^D)$, or —$N(R^C)C(O)R^A$;

each $R^8$ is independently $C_1$-$C_6$ alkyl, cyano, —$OR^B$, —$N(R^C)(R^D)$, —$C(O)N(R^C)(R^D)$, or —$N(R^C)C(O)R^A$;

n is 0, 1, 2, or 3;

is 0, 1, 2, 3, 4, or 5; and x is 0, 1, or 2.

In some embodiments, the COF2 is thalidomide or analogue, or a pharmaceutically acceptable salt thereof. In some embodiments, the COF2 is selected from the group consisting of lenalidomide, pomalidomide, thalidomide, and 2-(4-(tert-butyl)phenyl)-N-((2-(2,6-dioxopiperidin-3-yl)-1-oxoisoindolin-5-yl)methyl)acetamide, or a pharmaceutically acceptable salt thereof.

In some embodiments, the COF2 is selected from the group consisting of:

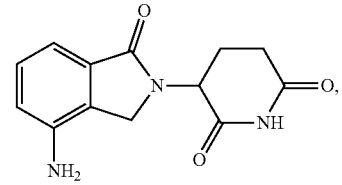

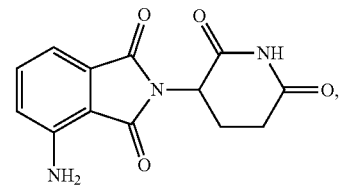

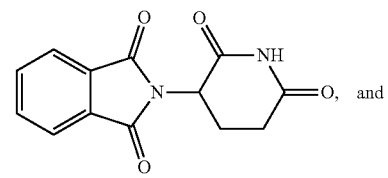

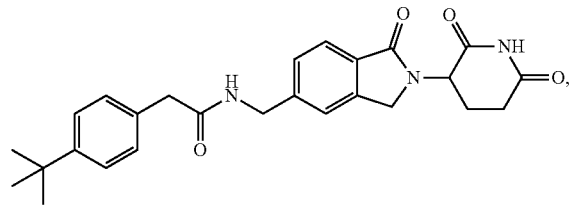

or a pharmaceutically acceptable salt thereof.

In some embodiments, the COF2 is lenalidomide or pomalidomide, or a pharmaceutically acceptable salt thereof. In some embodiments, the COF2 is lenalidomide or analogue, or a pharmaceutically acceptable salt thereof. In some embodiments, the COF2 is lenalidomide, or a pharmaceutically acceptable salt thereof.

In some embodiments, the COF2 comprises the structure of Formula (I):

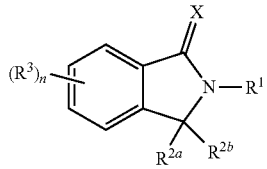

or a pharmaceutically acceptable salt, ester, hydrate, solvate, or tautomer thereof, wherein:
X is O or S;
$R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by one or more $R^4$;
each of $R^{2a}$ and $R^{2b}$ is independently hydrogen or $C_1$-$C_6$ alkyl; or $R^{2a}$ and $R^{2b}$ together with the carbon atom to which they are attached form a carbonyl group or a thiocarbonyl group;
each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), or —N($R^C$)S(O)$_x$$R^E$, wherein each alkyl, alkenyl, alkynyl, and heteroalkyl is independently and optionally substituted with one or more $R^6$;
each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), —N($R^C$)S(O)$_x$$R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^7$;
each of $R^A$, $R^B$, $R^C$, $R^D$, and $R^E$ is independently hydrogen or $C_1$-$C_6$ alkyl;
each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with one or more $R^8$;
each $R^7$ is independently halo, oxo, cyano, —O$R^B$, —N($R^C$)($R^D$), —C(O)N($R^C$)($R^D$), or —N($R^C$)C(O)$R^A$;
each $R^8$ is independently $C_1$-$C_6$ alkyl, cyano, —O$R^B$, —N($R^C$)($R^D$), —C(O)N($R^C$)($R^D$), or —N($R^C$)C(O)$R^A$;
n is 0, 1, 2, 3 or 4; and
x is 0, 1, or 2.

In some embodiments, the COF2 comprises the structure of Formula (I-a):

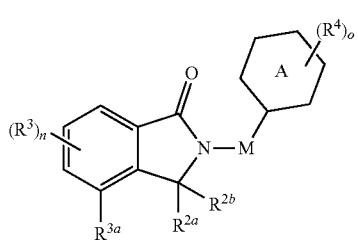

or a pharmaceutically acceptable salt, ester, hydrate, or tautomer thereof, wherein:
Ring A is carbocyclyl, heterocyclyl, aryl, or heteroaryl, each of which is independently and optionally substituted with one or more $R^4$;
M is absent, $C_1$-$C_6$ alkyl, $C_2$-$C_6$ alkenyl, $C_2$-$C_6$ alkynyl, or $C_1$-$C_6$ heteroalkyl, wherein each alkyl, alkenyl, alkynyl, and heteroalkyl is independently and optionally substituted with one or more $R^4$;
each of $R^{2a}$ and $R^{2b}$ is independently hydrogen or $C_1$-$C_6$ alkyl; or $R^{2a}$ and $R^{2b}$ together with the carbon atom to which they are attached to form a carbonyl group or thiocarbonyl group;
$R^{3a}$ is hydrogen, $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), or —N($R^C$)S(O)$_x$$R^E$, wherein each alkyl, alkenyl, alkynyl, and heteroalkyl is independently and optionally substituted with one or more $R^6$;
each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), or —N($R^C$)S(O)$_x$$R^E$, wherein each alkyl, alkenyl, alkynyl, and heteroalkyl is independently and optionally substituted with one or more $R^6$;
each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, S(O)$_x$$R^E$, —S(O)$_x$N($R^C$)($R^D$), —N($R^C$)S(O)$_x$$R^E$, carbocyclyl, heterocyclyl, aryl, or heteroaryl, wherein each alkyl, alkenyl, alkynyl, carbocyclyl, heterocyclyl, aryl, and heteroaryl is independently and optionally substituted with one or more $R^7$;
each of $R^A$, $R^B$, $R^C$, $R^D$, and $R^E$ is independently hydrogen or $C_1$-$C_6$ alkyl;
each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with one or more $R^8$;
each $R^7$ is independently halo, oxo, cyano, —O$R^B$, —N($R^C$)($R^D$), —C(O)N($R^C$)($R^D$), or —N($R^C$)C(O)$R^A$;
each $R^8$ is independently $C_1$-$C_6$ alkyl, cyano, —O$R^B$, —N($R^C$)($R^D$), —C(O)N($R^C$)($R^D$), or —N($R^C$)C(O)$R^A$;
n is 0, 1, 2, or 3;
is 0, 1, 2, 3, 4, or 5; and
x is 0, 1, or 2.

In some embodiments, the COF2 comprises an immunomodulatory imide drug (IMiD), or a pharmaceutically acceptable salt thereof. In some embodiments, the COF2 comprises thalidomide or analogue, or a pharmaceutically acceptable salt thereof. In some embodiments, the COF2 comprises lenalidomide, pomalidomide, thalidomide, and 2-(4-(tert-butyl)phenyl)-N-((2-(2,6-dioxopiperidin-3-yl)-1-oxoisoindolin-5-yl)methyl)acetamide, or a pharmaceutically acceptable salt thereof.

In some embodiments, the COF2 comprises a compound selected from the group consisting of:

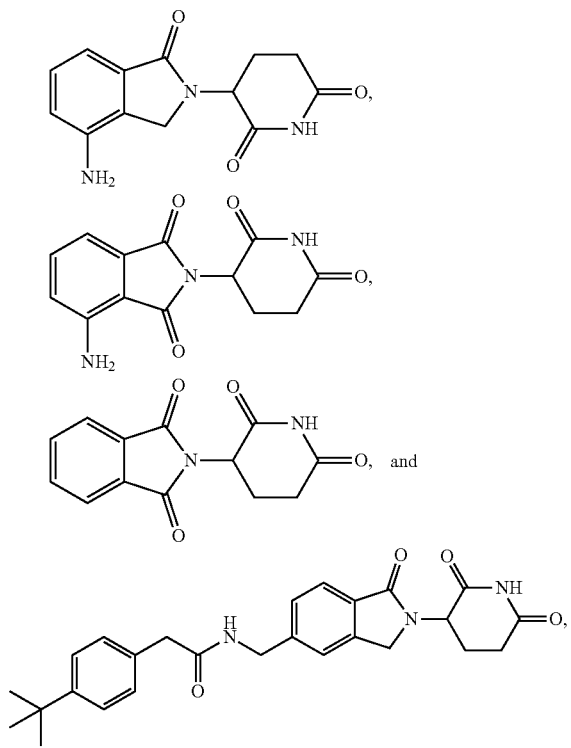

or a pharmaceutically acceptable salt thereof.

In some embodiments, the COF2 comprises lenalidomide or pomalidomide, or a pharmaceutically acceptable salt thereof. In some embodiments, the COF2 comprises lenalidomide or analogue, or a pharmaceutically acceptable salt thereof. In some embodiments, the COF2 comprises lenalidomide, or a pharmaceutically acceptable salt thereof.

In some embodiments, the COF2 further comprises a ligand (e.g., wherein $R^{10}$ in Formula (II) is L-Tag). In some embodiments, $R^{10}$ in Formula (II) is L-Tag, L is a linker selected from a linker disclosed in International Patent Publication No. WO2017/024318 (e.g., FIGS. 28-31), and Tag is selected from a dTAG Targeting Ligand disclosed in International Patent Publication No. WO2017/024318 (e.g., Table T, pages 119-129). In some embodiments, the COF2 comprises IMiD (e.g., lenalidomide or pomalidomide, or a pharmaceutically acceptable salt thereof) and a ligand, wherein the IMiD (e.g., lenalidomide or pomalidomide, or a pharmaceutically acceptable salt thereof) is linked to the ligand, e.g., via a linker. In some embodiments, the COF2/CRBN-binding polypeptide binds to the ligand and wherein the binding between the COF2/CRBN-binding polypeptide and IMiD (e.g., lenalidomide or pomalidomide, or a pharmaceutically acceptable salt thereof) in the absence of the ligand is no more than 0.0001, 0.001, 0.01, 0.1, 1, or 10% of the binding between the COF2/CRBN-binding polypeptide and the ligand, e.g., the COF2/CRBN-binding polypeptide does not bind to IMiD (e.g., lenalidomide or pomalidomide, or a pharmaceutically acceptable salt thereof), optionally wherein the COF2/CRBN-binding polypeptide is selected from a dTAG disclosed in International Patent Publication No. WO2017/024318 (e.g., pages 36-65).

In one aspect, provided herein is a fusion polypeptide comprising a compound of Formula (III) (COF3)/CRBN-binding polypeptide and a heterologous polypeptide, wherein the compound of Formula (III) is:

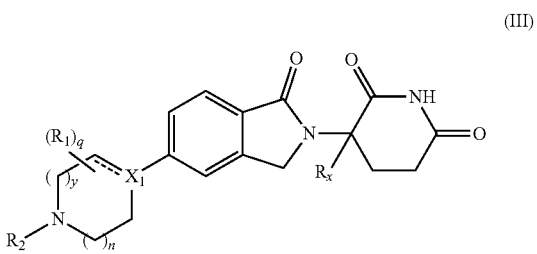

(III)

or a pharmaceutically acceptable salt, ester, hydrate, solvate, or tautomer thereof, wherein:

$X_1$ is $CR_3$;

----- is optionally a double bond when $X_1$ is $CR_3$ and $R_3$ is absent;

each $R_1$ is independently $C_1$-$C_6$ alkyl, $C_1$-$C_6$ haloalkyl, $C_1$-$C_6$ hydroxyalkyl, or halo, or two $R_1$ together with the carbon atoms to which they are attached form a 5- or 6-membered heterocyclyl ring, or two $R_1$, when on adjacent atoms, together with the atoms to which they are attached form a $C_6$-$C_{10}$ aryl or 5- or 6-membered heteroaryl ring comprising 1 to 3 heteroatoms selected from O, N, and S;

$R_2$ is hydrogen, $C_1$-$C_6$ alkyl, —C(O)$C_1$-$C_6$ alkyl, —C(O)(CH$_2$)$_{0-3}$—$C_6$-$C_{10}$ aryl, —C(O)O(CH$_2$)$_{0-3}$—$C_6$-$C_{10}$aryl, $C_6$-$C_{10}$ aryl, or 5- or 6-membered heteroaryl comprising 1 to 3 heteroatoms selected from O, N, and S, $C_3$-$C_8$ carbocyclyl, or 5- to 7-heterocyclyl comprising 1 to 3 heteroatoms selected from O, N, and S, wherein the alkyl is optionally substituted with one or more $R_4$; and the aryl, heteroaryl, carbocyclyl, and heterocyclyl are optionally substituted with one or more $R_5$, or $R_1$ and $R_2$, when on adjacent atoms, together with the atoms to which they are attached form a 5- or 6-membered heterocyclyl ring;

$R_3$ is hydrogen, or $R_3$ is absent when ----- is a double bond;

each $R_4$ is independently selected from —C(O)O$R_6$, —C(O)N$R_6R_{6'}$, —N$R_6$C(O)$R_{6'}$, halo, —OH, —NH$_2$, cyano, $C_6$-$C_{10}$ aryl, 5- or 6-membered heteroaryl comprising 1 to 4 heteroatoms selected from O, N, and S, $C_3$-$C_8$ carbocyclyl, and 5- to 7-membered heterocyclyl ring comprising 1 to 3 heteroatoms selected from O, N, and S, wherein the aryl, heteroaryl, carbocyclyl, and heterocyclyl are optionally substituted with one or more $R_7$;

each $R_5$ is independently selected from $C_1$-$C_6$ alkyl, $C_2$-$C_6$ alkenyl, $C_2$-$C_6$ alkynyl, $C_1$-$C_6$ alkoxy, $C_1$-$C_6$ haloalkyl, $C_1$-$C_6$ haloalkoxy, $C_1$-$C_6$ hydroxyalkyl, halo, —OH, —NH$_2$, cyano, $C_3$-$C_7$ carbocyclyl, 5- to 7-membered heterocyclyl comprising 1 to 3 heteroatoms selected from O, N, and S, $C_6$-$C_{10}$ aryl, and 5- or 6-membered heteroaryl comprising 1 to 3 heteroatoms selected from O, N, and S, or two $R_5$, when on adjacent atoms, together with the atoms to which they are attached form a $C_6$-$C_{10}$ aryl or 5- or 6-membered heteroaryl comprising 1 to 3 heteroatoms selected from O, N, and S, optionally substituted with one or more $R_{10}$, or two $R_5$, when on adjacent atoms, together with the atoms to which they are attached form a $C_5$-$C_7$ carbocyclyl or 5- to 7-membered heterocyclyl comprising 1 to 3 heteroatoms selected from O, N, and S optionally substituted with one or more $R_{10}$;

$R_6$ and $R_C$ are each independently hydrogen, $C_1$-$C_6$ alkyl, or $C_6$-$C_{10}$ aryl;

each $R_7$ is independently selected from $C_1$-$C_6$ alkyl, $C_2$-$C_6$ alkenyl, $C_2$-$C_6$ alkynyl, $C_1$-$C_6$ alkoxy, $C_1$-$C_6$ haloalkyl, $C_1$-$C_6$ haloalkoxy, —C(O)$R_8$, —(CH$_2$)$_{0-3}$C(O)O$R_8$, —C(O)N$R_8R_9$, —N$R_8$C(O)$R_9$, —N$R_8$C(O)O$R_9$, —S(O)$_p$N$R_8R_9$, —S(O)$_p$$R_{12}$, ($C_1$-$C_6$)hydroxyalkyl, halo, —OH, —O(CH$_2$)$_{1-3}$CN, —NH$_2$, cyano, —O(CH$_2$)$_{0-3}$—$C_6$-$C_{10}$ aryl, adamantyl, —O(CH$_2$)$_{0-3}$-5- or 6-membered heteroaryl comprising 1 to 3 heteroatoms selected from O, N, and S, $C_6$-$C_{10}$ aryl, monocyclic or bicyclic 5- to 10-membered heteroaryl comprising 1 to 3 heteroatoms selected from O, N, and S, $C_3$-$C_7$ carbocyclyl, and 5- to 7-membered heterocyclyl comprising 1 to 3 heteroatoms selected from O, N, and S, wherein the alkyl is optionally substituted with one or more $R_{11}$, and the aryl, heteroaryl, and heterocyclyl are optionally substituted with one or more substituents each independently selected from halogen, $C_1$-$C_6$ alkyl, $C_1$-$C_6$ haloalkyl, and $C_1$-$C_6$ alkoxy, or two $R_7$ together with the carbon atom to which they are attached form a =(O), or two $R_7$, when on adjacent atoms, together with the atoms to which they are attached form a $C_6$-$C_{10}$ aryl or 5- or 6-membered heteroaryl comprising 1 to 3 heteroatoms selected from O, N, and S, optionally substituted with one or more $R_{10}$, or two $R_7$ together with the atoms to which they are attached form a $C_5$-$C_7$ carbocyclyl or a 5- to 7-membered heterocyclyl comprising 1 to 3 heteroatoms selected from O, N, and S, optionally substituted with one or more $R_{10}$;

$R_8$ and $R_9$ are each independently hydrogen or $C_1$-$C_6$ alkyl;

each $R_{10}$ is independently selected from $C_1$-$C_6$ alkyl, $C_1$-$C_6$ alkoxy, $C_1$-$C_6$ haloalkyl, $C_1$-$C_6$ haloalkoxy, $C_1$-$C_6$ hydroxyalkyl, halo, —OH, —NH$_2$, and cyano, or two $R_{10}$ together with the carbon atom to which they are attached form a =(O);

each $R_{11}$ is independently selected from cyano, $C_1$-$C_6$ alkoxy, $C_6$-$C_{10}$ aryl, and 5- to 7-membered heterocyclyl comprising 1 to 3 heteroatoms selected from O, N, and S, wherein each aryl and heterocyclyl is optionally substituted with one or more substituents each independently selected from $C_1$-$C_6$ alkyl, $C_1$-$C_6$ alkoxy, $C_1$-$C_6$ haloalkyl, $C_1$-$C_6$ haloalkoxy, $C_1$-$C_6$ hydroxyalkyl, halo, —OH, —NH$_2$, and cyano;

$R_{12}$ is $C_1$-$C_6$ alkyl, $C_1$-$C_6$ haloalkyl, $C_6$-$C_{10}$ aryl, or 5- to 7-membered heterocyclyl comprising 1 to 3 heteroatoms selected from O, N, and S;

$R_x$ is hydrogen or deuterium;

p is 0, 1, or 2;

n is 0, 1, or 2;

y is 1 or 2, wherein n+y≤3; and q is 0, 1, 2, 3, or 4.

In one embodiment, the compound of Formula (III) is a compound of Formula (III-b):

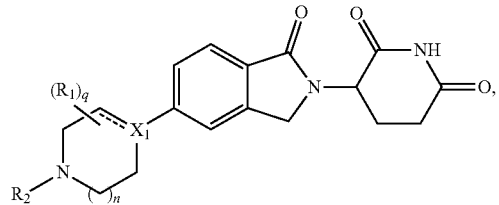

(III-b)

or a pharmaceutically acceptable salt, hydrate, solvate, prodrug, stereoisomer, and tautomer thereof, wherein $X_1$, $R_1$, $R_2$, n, q, and subvariables thereof are defined as described above for Formula (III).

In one embodiment, the compound of Formula (III) is a compound of Formula (III-d):

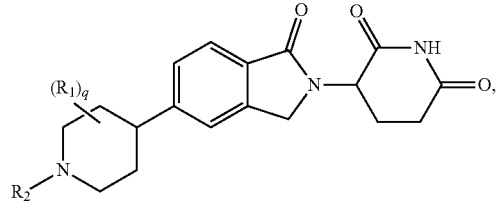

(III-d)

or a pharmaceutically acceptable salt, hydrate, solvate, prodrug, stereoisomer, and tautomer thereof, wherein $R_1$, $R_2$, q, and subvariables thereof are defined as described above for Formula (III).

In one embodiment, the COF3/CRBN-binding polypeptide is fused to the heterologous polypeptide. In one embodiment, the COF3/CRBN-binding polypeptide and the heterologous polypeptide are linked by a peptide bond. In one embodiment, the COF3/CRBN-binding polypeptide and the heterologous polypeptide are linked by a bond other than a peptide bond. In one embodiment, the heterologous polypeptide is linked directly to the COF3/CRBN-binding polypeptide. In one embodiment, the heterologous polypeptide is linked indirectly to the COF3/CRBN-binding polypeptide. In one embodiment, the COF3/CRBN-binding polypeptide and the heterologous polypeptide are operatively linked via a linker, e.g., a glycine-serine linker, e.g., a linker comprising the amino acid sequence of SEQ ID NO: 28. In one embodiment, the COF3/CRBN-binding polypeptide is linked to the C-terminus of the heterologous polypeptide. In one embodiment, the COF3/CRBN-binding polypeptide is linked to the N-terminus of the heterologous polypeptide.

In one embodiment, the association of the fusion polypeptide with CRBN in the absence of COF3 is no more than, e.g., 0.01%, 0.1%, 1%, 5%, 10%, 15%, or 20%, of the association of the fusion polypeptide with CRBN in the presence of COF3, e.g., an excess of COF3, e.g., as measured by an assay described herein, e.g., immunoprecipitation. In one embodiment, the fusion polypeptide does not bind to CRBN in the absence of COF3. In one embodiment, the ubiquitination of the fusion polypeptide in the absence of COF3 is no more than, e.g., 0.01%, 0.1%, 1%, 10%, 20%, 30%, 40%, 50%, 60%, or 70%, of the ubiquitination of the fusion polypeptide in the presence of COF3, e.g., an excess of COF3, e.g., as measured by an assay described herein. In one embodiment, the fusion polypeptide is ubiquitinated at one or more lysine or methionine residues in the presence of COF3. In one embodiment, the degradation of the fusion polypeptide in the absence of COF3 is no more than, e.g., 0.01%, 0.1%, 1%, 10%, 20%, 30%, 40%, 50%, 60%, or 70% of the degradation of the fusion polypeptide in the presence of COF3, e.g., an excess of COF3, e.g., as measured by an assay described herein, e.g., a Western blot analysis or a flow cytometry analysis. In one embodiment, the degradation of the fusion polypeptide is mediated by ubiquitination in the presence of COF3. In one embodiment, the association, ubiquitination, and/or degradation is as measured in a mammalian cell, e.g., a human cell.

In one embodiment, the COF3/CRBN-binding polypeptide is between 10 and 95 amino acid residues in length, between 15 and 90 amino acid residues in length, between 20 and 85 amino acid residues in length, between 25 and 80 amino acid residues in length, between 30 and 75 amino acid residues in length, between 35 and 70 amino acid residues in length, between 40 and 65 amino acid residues in length, between 45 and 65 amino acid residues in length, between 50 and 65 amino acid residues in length, or between 55 and 65 amino acid residues in length. In one embodiment, the COF3/CRBN-binding polypeptide is 59 amino acid residues in length.

In one embodiment, the COF3/CRBN-binding polypeptide comprises a beta turn. In one embodiment, the COF3/CRBN-binding polypeptide comprises a beta hairpin. In one embodiment, the COF3/CRBN-binding polypeptide comprises a beta strand. In one embodiment, the COF3/CRBN-binding polypeptide comprises an alpha helix. In one embodiment, the COF3/CRBN-binding polypeptide comprises, from N-terminus to C-terminus, a first beta strand, a beta hairpin, a second beta strand, and a first alpha helix. In one embodiment, the COF3/CRBN-binding polypeptide comprises, from N-terminus to C-terminus, a first beta strand, a beta hairpin, a second beta strand, a first alpha helix, and a second alpha helix. In one embodiment, the beta hairpin and the second alpha helix are separated by no more than 60, 50, 40, or 30 amino acid residues.

In one embodiment, the COF3/CRBN-binding polypeptide comprises a COF3/CRBN-binding sequence from a naturally occurring polypeptide or a COF3/CRBN-binding variant thereof. In one embodiment, the COF3/CRBN-binding polypeptide comprises a COF3/CRBN-binding sequence from a naturally occurring IKZF polypeptide or a COF3/CRBN-binding variant thereof. In one embodiment, the COF3/CRBN-binding polypeptide comprises a COF3/CRBN-binding sequence from a naturally occurring IKZF2, or a COF3/CRBN-binding variant thereof. In one embodiment, the COF3/CRBN-binding polypeptide comprises two or more discontinuous sequences from a naturally occurring IKZF polypeptide, e.g., a naturally occurring IKZF2.

In one embodiment, the COF3/CRBN-binding polypeptide comprises amino acid residues 130-174 of IKZF2 (numbered according to SEQ ID NO: 21). In one embodiment, the COF3/CRBN-binding polypeptide comprises the amino acid sequence of SEQ ID NO: 113. In one embodiment, the COF3/CRBN-binding polypeptide comprises a sequence that differs from amino acid residues 130-174 of IKZF2 (numbered according to SEQ ID NO: 21) by no more than 1, 2, 3, 4, 5, 10, 15, 20, 25, 30, 35, or 40 amino acid residues. In one embodiment, the COF3/CRBN-binding polypeptide comprises a sequence that differs from amino acid residues 130-174 of SEQ ID NO: 21 by no more than 1, 2, 3, 4, 5, 10, 15, 20, 25, 30, 35, or 40 amino acid residues. In one embodiment, the COF3/CRBN-binding polypeptide comprise a sequence having no more than 1, 2, 3, 4, 5, 10, 15, 20, 25, 30, 35, or 40 amino acid substitutions from amino acid residues 130-174 of SEQ ID NO: 21.

In one embodiment, the COF3/CRBN-binding polypeptide comprises amino acid residues 230-243 of IKZF2 (numbered according to SEQ ID NO: 21). In one embodiment, the COF3/CRBN-binding polypeptide comprises the amino acid sequence of SEQ ID NO: 114. In one embodiment, the COF3/CRBN-binding polypeptide comprises a sequence that differs from amino acid residues 230-243 of IKZF2 (numbered according to SEQ ID NO: 21) by no more than 1, 2, 3, 4, 5, or 10 amino acid residues. In one embodiment, the COF3/CRBN-binding polypeptide comprises a sequence that differs from amino acid residues 230-243 of SEQ ID NO: 21 by no more than 1, 2, 3, 4, 5, or 10 amino acid residues. In one embodiment, the COF3/CRBN-binding polypeptide comprises a sequence having no more than 1, 2, 3, 4, 5, or 10 amino acid substitutions from amino acid residues 230-243 of SEQ ID NO: 21.

In one embodiment, histidine at position 141 remains unaltered, numbered according to SEQ ID NO: 21.

In one embodiment, the COF3/CRBN-binding polypeptide comprises amino acid residues 130-174 of IKZF2 (numbered according to SEQ ID NO: 21). In one embodiment, the COF3/CRBN-binding polypeptide comprises the amino acid sequence of SEQ ID NO: 113. In one embodiment, the COF3/CRBN-binding polypeptide comprises amino acid residues 230-243 of IKZF2 (numbered according to SEQ ID NO: 21). In one embodiment, the COF3/CRBN-binding polypeptide comprises the amino acid sequence of SEQ ID NO: 114. In one embodiment, the COF3/CRBN-binding polypeptide comprises or consists of the amino acid sequence of SEQ ID NO: 109.

In some embodiments, the fusion polypeptide further comprises a degradation domain, wherein the degradation domain is separated from the COF3/CRBN-binding polypeptide and the heterologous polypeptide by a heterologous protease cleavage site.

In some embodiments, the fusion polypeptide comprises, from N-terminus to C-terminus:

i) the degradation domain, the heterologous protease cleavage site, the heterologous polypeptide, and the COF3/CRBN-binding polypeptide;

ii) the degradation domain, the heterologous protease cleavage site, the COF3/CRBN-binding polypeptide, and the heterologous polypeptide;

iii) the COF3/CRBN-binding polypeptide, the heterologous polypeptide, the heterologous protease cleavage site, and the degradation domain; or iv) the heterologous polypeptide, and the COF3/CRBN-binding polypeptide, the heterologous protease cleavage site, and the degradation domain.

In some embodiments, the fusion polypeptide comprises, from N-terminus to C-terminus, the degradation domain, the heterologous protease cleavage site, the heterologous polypeptide, and the COF3/CRBN-binding polypeptide.

In some embodiments, the degradation domain has a first state associated with a first level of expression of the fusion polypeptide and a second state associated with a second level of expression of the fusion polypeptide, wherein the second level is increased, e.g., by at least 2-, 3-, 4-, 5-, 10-, 20- or 30-fold over the first level in the presence of a stabilization compound.

In some embodiments, in the absence of the stabilization compound, the fusion polypeptide is degraded by a cellular degradation pathway, e.g., at least 50%, 60%, 70%, 80%, 90% or greater of the fusion polypeptide is degraded, e.g., as measured by an assay described herein, e.g., a Western blot analysis or a flow cytometry analysis.

In some embodiments, the level of expression, and/or degradation is as measured in a mammalian cell, e.g., a human cell.

In some embodiments, in the presence of the stabilization compound:
i) the degradation domain assumes a conformation more resistant to cellular degradation relative to a conformation in the absence of the stabilization compound; or
ii) the conformation of the fusion polypeptide is more permissive to cleavage at the heterologous protease cleavage site relative to a conformation in the absence of the stabilization compound.

In some embodiments, the degradation domain is chosen from an estrogen receptor (ER) domain, an FKB protein (FKBP) domain, or a dihydrofolate reductase (DHFR) domain.

In some embodiments, the degradation domain is an estrogen receptor (ER) domain. In some embodiments, the degradation domain comprises an amino acid sequence that is at least 90, 95, 97, 98, 99, or 100% identical to SEQ ID NO: 46 or 48. In some embodiments, the degradation domain comprises the amino acid sequence of SEQ ID NO: 46. In some embodiments, the degradation domain comprises the amino acid sequence of SEQ ID NO: 48.

In some embodiments, the stabilization compound is bazedoxifene or 4-hydroxy tamoxifen (4-OHT), or a pharmaceutically acceptable salt thereof. In some embodiments, the degradation domain is an estrogen receptor (ER) domain and the stabilization compound is bazedoxifene, or a pharmaceutically acceptable salt thereof. In some embodiments, the degradation domain comprises the amino acid sequence of SEQ ID NO: 46 and the stabilization compound is bazedoxifene, or a pharmaceutically acceptable salt thereof.

In some embodiments, the degradation domain is an FKB protein (FKBP) domain. In some embodiments, the degradation domain comprises an amino acid sequence that is at least 90, 95, 97, 98, 99, or 100% identical to SEQ ID NO: 50. In some embodiments, the degradation domain comprises the amino acid sequence of SEQ ID NO: 50. In some embodiments, the stabilization compound is Shield-1, or a pharmaceutically acceptable salt thereof.

In some embodiments, the degradation domain is a dihydrofolate reductase (DHFR) domain. In some embodiments, the degradation domain comprises an amino acid sequence that is at least 90, 95, 97, 98, 99, or 100% identical to SEQ ID NO: 51. In some embodiments, the degradation domain comprises the amino acid sequence of SEQ ID NO: 51. In some embodiments, the stabilization compound is trimethoprim, or a pharmaceutically acceptable salt thereof.

In some embodiments, the heterologous protease cleavage site is cleaved by a mammalian intracellular protease. In some embodiments, the heterologous protease cleavage site is cleaved by a protease selected from the group consisting of furin, PCSK1, PCSK5, PCSK6, PCSK7, cathepsin B, Granzyme B, Factor XA, Enterokinase, genenase, sortase, precission protease, thrombin, TEV protease, and elastase 1. In some embodiments, the heterologous protease cleavage site comprises a sequence having a cleavage motif selected from the group consisting of RX(K/R)R consensus motif (X can be any amino acid; SEQ ID NO: 52), RXXX[KR]R consensus motif (X can be any amino acid; SEQ ID NO: 53), RRX consensus motif (SEQ ID NO: 54), I-E-P-D-X consensus motif (SEQ ID NO: 55), Ile-Glu/Asp-Gly-Arg (SEQ ID NO: 56), Asp-Asp-Asp-Asp-Lys (SEQ ID NO: 57), Pro-Gly-Ala-Ala-His-Tyr (SEQ ID NO: 58), LPXTG/A consensus motif (SEQ ID NO: 59), Leu-Glu-Val-Phe-Gln-Gly-Pro (SEQ ID NO: 60), Leu-Val-Pro-Arg-Gly-Ser (SEQ ID NO: 61), E-N-L-Y-F-Q-G (SEQ ID NO: 62), and [AGSV]-X (X can be any amino acid; SEQ ID NO: 63). In some embodiments, the heterologous protease cleavage site is cleaved by furin. In some embodiments, the heterologous protease cleavage site comprises a furin cleavage site selected from the group consisting of RTKR (SEQ ID NO: 123); GTGAEDPRPSRKRRSLGDVG (SEQ ID NO: 125); GTGAEDPRPSRKRR (SEQ ID NO: 127); LQWLEQQ-VAKRRTKR (SEQ ID NO: 129); GTGAE-DPRPSRKRRSLGG (SEQ ID NO: 131); GTGAE-DPRPSRKRRSLG (SEQ ID NO: 133); SLNLTESHNSRKKR (SEQ ID NO: 135); CKINGYPKR-GRKRR (SEQ ID NO: 137); and SARNRQKR (SEQ ID NO: 34). In some embodiments, the heterologous protease cleavage site does not comprise the amino acid sequence of SARNRQKR (SEQ ID NO: 34). In some embodiments, the heterologous protease cleavage site comprises the furin cleavage site of GTGAEDPRPSRKRRSLGDVG (SEQ ID NO: 125). In some embodiments, the heterologous protease cleavage site is cleaved by a mammalian extracellular protease. In some embodiments, the mammalian extracellular protease is selected from the group consisting of Factor XA, Enterokinase, genenase, sortase, precission protease, thrombin, TEV protease, and elastase 1. In some embodiments, the heterologous protease cleavage site comprises an amino acid sequence selected from the group consisting of Ile-Glu/Asp-Gly-Arg (SEQ ID NO: 56), Asp-Asp-Asp-Asp-Lys (SEQ ID NO: 57), Pro-Gly-Ala-Ala-His-Tyr (SEQ ID NO: 58), LPXTG/A consensus motif (SEQ ID NO: 59), Leu-Glu-Val-Phe-Gln-Gly-Pro (SEQ ID NO: 60), Leu-Val-Pro-Arg-Gly-Ser (SEQ ID NO: 61), E-N-L-Y-F-Q-G (SEQ ID NO: 62), and [AGSV]-X (X can be any amino acid; SEQ ID NO: 63).

In certain embodiments of the foregoing aspects, the heterologous polypeptide is chosen from a cytoplasmic and/or nuclear polypeptide, or a transmembrane polypeptide, e.g., a heterologous polypeptide in Table 2. In some embodiments, the cytoplasmic and/or nuclear polypeptide is selected from the group consisting of a component of the apoptosis pathway (e.g., Caspase 9), a component of a CRISPR/Cas system (e.g., Cas9), a transcription factor (e.g., MITF, c-Myc, STAT3, STAT5, NF-kappaB, beta-catenin, Notch, GLI, or c-JUN), Tet methylcytosine dioxygenase 2 (TET2), FKBP, and Tau. In some embodiments, the transmembrane polypeptide is selected from the group consisting of CD62L, CCR1, CCR2, CCR5, CCR7, CCR10, CXCR2, CXCR3, CXCR4, CXCR6, CTLA4, PD1, BTLA, VISTA, CD137L, CD80, CD86, TIGIT, CD3, CD8, CD19, CD22, CD20, BCMA, and a chimeric antigen receptor (CAR). In some embodiments, the heterologous polypeptide is selected from the group consisting of a chimeric antigen receptor (CAR), a component of a CRISPR/Cas system (e.g., Cas9), CD8, CD19, and CD22.

In some embodiments, the heterologous polypeptide is a chimeric antigen receptor (CAR). In some embodiments, the CAR comprises, in a N-terminal to C-terminal direction, an antigen binding domain, a transmembrane domain, and one or more intracellular signaling domains. In some embodiments, the intracellular signaling domain comprises one or more primary signaling domains. In some embodiments, the intracellular signaling domain comprises one or more costimulatory signaling domains. In some embodiments, one of the one or more primary signaling domains comprises a CD3-zeta stimulatory domain. In some embodiments, one or more of the costimulatory signaling domains is an intracellular domain from a costimulatory protein selected from the group consisting of CD27, CD28, 4-1BB (CD137), OX40, GITR, CD30, CD40, ICOS, BAFFR, HVEM, ICAM-1, lymphocyte function-associated antigen-1 (LFA-1), CD2, CDS, CD7, CD287, LIGHT, NKG2C, NKG2D, SLAMF7, NKp80, NKp30, NKp44, NKp46, CD160, B7-H3, and a ligand that specifically binds with CD83. In some embodiments, the one or more of said costimulatory signaling domains comprises the 4-1BB costimulatory domain. In some embodiments, the one or more of said costimulatory signaling domains comprises the CD28 costimulatory domain. In some embodiments, the antigen binding domain is an scFv.

In some embodiments, the antigen binding domain binds an antigen selected from the group consisting of CD19; CD123; CD22; CD30; CD171; CS-1; C-type lectin-like molecule-1, CD33; epidermal growth factor receptor variant III (EGFRvIII); ganglioside G2 (GD2); ganglioside GD3; TNF receptor family member; B-cell maturation antigen; Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2; Mesothelin; Interleukin 11 receptor alpha (IL-11Ra); prostate stem cell antigen (PSCA); Protease Serine 21; vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene polypeptide consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3; transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1, melanoma antigen recognized by T cells 1; Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like, Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1). In some embodiments, the antigen is chosen from CD19, CD22, BCMA, CD20, CD123, EGFRvIII, or mesothelin. In some embodiments, the antigen is CD19. In some embodiments, the antigen is CD22. In some embodiments, the antigen is BCMA. In some embodiments, the antigen is CD20. In some embodiments, the antigen is CD123. In some embodiments, the antigen is EGFRvIII.

In one aspect, provided herein is a nucleic acid molecule encoding a fusion polypeptide disclosed herein. In another aspect, provided herein is a vector comprising the nucleic acid molecule. In some embodiments, the vector is a viral vector. In some embodiments, the vector is a lentiviral vector. In another aspect, provided herein is a viral particle comprising the vector.

In another aspect, provided herein is a cell, e.g., a host cell, comprising a fusion polypeptide disclosed herein, a nucleic acid molecule disclosed herein, or a vector disclosed herein. In some embodiments, the cell, e.g., host cell, is a mammalian cell, e.g., a human cell, e.g., a human effector cell, e.g., a human T cell or a human NK cell.

In some embodiments, the cell, e.g., host cell, is a CAR-expressing cell, e.g., a CAR-T cell. In some embodiments, the cell, e.g., host cell, comprises a component of a CRISPR/Cas system. In some embodiments, the cell, e.g., host cell, is a human cancer cell, e.g., a human tumor cell.

In some embodiments, the cell, e.g., host cell, comprises a ubiquitin ligase complex, e.g., an E3 ubiquitin ligase complex, wherein the ubiquitin ligase complex comprises CRBN.

In some embodiments, the cell comprises a fusion polypeptide disclosed herein (e.g., a fusion polypeptide comprising a COF1/CRBN-binding polypeptide and a heterologous polypeptide), wherein when the cell is contacted with COF1, e.g., an excess of COF1:
  i) the association of the COF1/CRBN-binding polypeptide with CRBN is increased by at least, e.g., 10-, 50-, 100-, 1000-, or 10000-fold, compared to the association of the COF1/CRBN-binding polypeptide with CRBN when the cell is not contacted with COF1, e.g., as measured by an assay described herein, e.g., immunoprecipitation;
  ii) the association of the fusion polypeptide with CRBN is increased by at least, e.g., 10-, 50-, 100-, 1000-, or 10000-fold, compared to the association of the fusion polypeptide with CRBN when the cell is not contacted with COF1, e.g., as measured by an assay described herein, e.g., immunoprecipitation;
  iii) the ubiquitination of the heterologous polypeptide is increased by at least, e.g., 1.5-, 2-, 3-, 4-, 5-, 10-, 20-, 30-, 40-, or 50-fold, compared to the ubiquitination of the heterologous polypeptide when the cell is not contacted with COF1, e.g., as measured by an assay described herein;
  iv) the ubiquitination of the fusion polypeptide is increased by at least, e.g., 1.5-, 2-, 3-, 4-, 5-, 10-, 20-, 30-, 40-, or 50-fold, compared to the ubiquitination of the fusion polypeptide when the cell is not contacted with COF1, e.g., as measured by an assay described herein;
  v) the degradation of the fusion polypeptide is increased by at least, e.g., 1.5-, 2-, 3-, 4-, 5-, 10-, 20-, 30-, 40-, or 50-fold, compared to the degradation of the fusion polypeptide when the cell is not contacted with COF1, e.g., as measured by an assay described herein, e.g., a Western blot analysis or a flow cytometry analysis; or
  vi) the expression level of the fusion polypeptide is no more than, e.g., 0.01%, 0.1%, 1%, 10%, 20%, 30%, 40%, 50%, 60%, or 70%, of the expression level of the fusion polypeptide when the cell is not contacted with COF1, e.g., as measured by an assay described herein, e.g., a Western blot analysis or a flow cytometry analysis.

In some embodiments, the cell further comprises COF1, e.g., lenalidomide or pomalidomide, or a pharmaceutically acceptable salt thereof.

In some embodiments, the cell comprises a fusion polypeptide disclosed herein (e.g., a fusion polypeptide comprising a COF3/CRBN-binding polypeptide and a heterologous polypeptide), wherein when the cell is contacted with COF3, e.g., an excess of COF3:
  i) the association of the COF3/CRBN-binding polypeptide with CRBN is increased by at least, e.g., 10-, 50-, 100-, 1000-, or 10000-fold, compared to the association of the COF3/CRBN-binding polypeptide with CRBN when the cell is not contacted with COF3, e.g., as measured by an assay described herein, e.g., immunoprecipitation;
  ii) the association of the fusion polypeptide with CRBN is increased by at least, e.g., 10-, 50-, 100-, 1000-, or 10000-fold, compared to the association of the fusion polypeptide with CRBN when the cell is not contacted with COF3, e.g., as measured by an assay described herein, e.g., immunoprecipitation;
  iii) the ubiquitination of the heterologous polypeptide is increased by at least, e.g., 1.5-, 2-, 3-, 4-, 5-, 10-, 20-, 30-, 40-, or 50-fold, compared to the ubiquitination of the heterologous polypeptide when the cell is not contacted with COF3, e.g., as measured by an assay described herein;
  iv) the ubiquitination of the fusion polypeptide is increased by at least, e.g., 1.5-, 2-, 3-, 4-, 5-, 10-, 20-, 30-, 40-, or 50-fold, compared to the ubiquitination of the fusion polypeptide when the cell is not contacted with COF3, e.g., as measured by an assay described herein;
  v) the degradation of the fusion polypeptide is increased by at least, e.g., 1.5-, 2-, 3-, 4-, 5-, 10-, 20-, 30-, 40-, or 50-fold, compared to the degradation of the fusion polypeptide when the cell is not contacted with COF3, e.g., as measured by an assay described herein, e.g., a Western blot analysis or a flow cytometry analysis; or
  vi) the expression level of the fusion polypeptide is no more than, e.g., 0.01%, 0.1%, 1%, 10%, 20%, 30%, 40%, 50%, 60%, or 70%, of the expression level of the fusion polypeptide when the cell is not contacted with COF3, e.g., as measured by an assay described herein, e.g., a Western blot analysis or a flow cytometry analysis.

In some embodiments, the cell further comprises COF3, e.g., a compound disclosed in Table 29, or a pharmaceutically acceptable salt thereof.

In some embodiments, the cell comprises a fusion polypeptide disclosed herein (e.g., a fusion polypeptide comprising a COF1/CRBN-, COF2/CRBN-, or COF3/CRBN-binding polypeptide, a heterologous polypeptide, and a degradation domain), wherein in the absence of a stabilization compound, the fusion polypeptide is degraded by a cellular degradation pathway, e.g., at least 50%, 60%, 70%, 80%, 90% or greater of the fusion polypeptide is degraded, e.g., as measured by an assay described herein, e.g., a Western blot analysis or a flow cytometry analysis.

In some embodiments, the fusion polypeptide further comprises a heterologous protease cleavage site. In some embodiments, the cell further comprises a protease capable of cleaving the heterologous protease cleavage site.

In some embodiments, the cell comprises a fusion polypeptide disclosed herein (e.g., a fusion polypeptide comprising a COF1/CRBN-, COF2/CRBN-, or COF3/CRBN-binding polypeptide, a heterologous polypeptide, and a degradation domain), wherein when the cell is contacted with a stabilization compound, e.g., an excess of a stabilization compound:
  i) the degradation domain assumes a conformation more resistant to cellular degradation relative to a conformation in the absence of the stabilization compound;
  ii) the conformation of the fusion polypeptide is more permissive to cleavage at the heterologous protease cleavage site relative to a conformation in the absence of the stabilization compound; or
  iii) the expression level of the fusion polypeptide is increased by at least, e.g., 1.5-, 2-, 3-, 4-, 5-, 10-, 20-, 30-, 40-, or 50-fold, compared to the expression level of the fusion polypeptide when the cell is not contacted with the stabilization compound, e.g., as measured by an assay described herein, e.g., a Western blot analysis or a flow cytometry analysis.

In some embodiments, the cell further comprises a stabilization compound. In some embodiments, the stabilization compound is bazedoxifene, or a pharmaceutically acceptable salt thereof. In some embodiments, the degradation domain comprises the amino acid sequence of SEQ ID NO: 46.

In some embodiments, the cell comprises a fusion polypeptide disclosed herein (e.g., a fusion polypeptide comprising a COF1/CRBN-, COF2/CRBN-, or COF3/CRBN-binding polypeptide, a heterologous polypeptide, and a degradation domain), wherein when the cell is contacted with both a stabilization compound, e.g., an excess of a stabilization compound, and COF1, COF2, or COF3, e.g., an excess of COF1, COF2, or COF3:
   i) the association of the COF1/CRBN-, COF2/CRBN-, or COF3/CRBN-binding polypeptide with CRBN is increased by at least, e.g., 10, 50, 100, 1000, or 10000 fold, compared to the association of the COF1/CRBN-, COF2/CRBN-, or COF3/CRBN-binding polypeptide with CRBN when the cell is only contacted with the stabilization compound but not COF1, COF2, or COF3, e.g., as measured by an assay described herein, e.g., immunoprecipitation;
   ii) the association of the fusion polypeptide with CRBN is increased by at least, e.g., 10-, 50-, 100-, 1000-, or 10000-fold, compared to the association of the fusion polypeptide with CRBN when the cell is only contacted with the stabilization compound but not COF1, COF2, or COF3, e.g., as measured by an assay described herein, e.g., immunoprecipitation;
   iii) the ubiquitination of the heterologous polypeptide is increased by at least, e.g., 1.5-, 2-, 3-, 4-, 5-, 10-, 20-, 30-, 40-, or 50-fold, compared to the ubiquitination of the heterologous polypeptide when the cell is only contacted with the stabilization compound but not COF1, COF2, or COF3, e.g., as measured by an assay described herein;
   iv) the ubiquitination of the fusion polypeptide is increased by at least, e.g., 1.5-, 2-, 3-, 4-, 5-, 10-, 20-, 30-, 40-, or 50-fold, compared to the ubiquitination of the fusion polypeptide when the cell is only contacted with the stabilization compound but not COF1, COF2, or COF3, e.g., as measured by an assay described herein;
   v) the degradation of the fusion polypeptide is increased by at least, e.g., 1.5-, 2-, 3-, 4-, 5-, 10-, 20-, 30-, 40-, or 50-fold, compared to the degradation of the fusion polypeptide when the cell is only contacted with the stabilization compound but not COF1, COF2, or COF3, e.g., as measured by an assay described herein, e.g., a Western blot analysis or a flow cytometry analysis; or
   vi) the expression level of the fusion polypeptide is no more than, e.g., 0.01%, 0.1%, 1%, 10%, 20%, 30%, 40%, 50%, 60%, or 70%, of the expression level of the fusion polypeptide when the cell is only contacted with the stabilization compound but not COF1, COF2, or COF3, e.g., as measured by an assay described herein, e.g., a Western blot analysis or a flow cytometry analysis.

In some embodiments, the cell further comprises COF1 (e.g., lenalidomide or pomalidomide, or a pharmaceutically acceptable salt thereof), COF2 (e.g., lenalidomide or pomalidomide, or a pharmaceutically acceptable salt thereof), or COF3 (a compound disclosed in Table 29, or a pharmaceutically acceptable salt thereof).

In some embodiments, the heterologous polypeptide is a chimeric antigen receptor (CAR), optionally wherein the CAR comprises, in a N-terminal to C-terminal direction, an antigen binding domain, a transmembrane domain, and one or more intracellular signaling domains.

In one aspect, disclosed herein is a pharmaceutical composition comprising a fusion polypeptide disclosed herein or a cell disclosed herein, and a pharmaceutically acceptable carrier, excipient or stabilizer.

In one aspect, disclosed herein is a method of making a cell disclosed herein.

In one aspect, disclosed herein is a method of degrading a fusion polypeptide disclosed herein (e.g., a fusion polypeptide comprising a COF1/CRBN-binding polypeptide and a heterologous polypeptide (e.g., a CAR polypeptide)), comprising contacting the fusion polypeptide or a cell comprising said fusion polypeptide with COF1 (e.g., lenalidomide or pomalidomide, or a pharmaceutically acceptable salt thereof). In some embodiments, in the presence of COF1 (e.g., lenalidomide or pomalidomide, or a pharmaceutically acceptable salt thereof), the expression level of said fusion polypeptide is substantially decreased, e.g., by at least about 1, 2, 3, 4, 5, 6, 7, 8, 9, 10, 20, 30, 40, 50, 60, 70, 80, 90, or 100 percent, relative to the expression level of said fusion polypeptide in the absence of COF1 (e.g., lenalidomide or pomalidomide, or a pharmaceutically acceptable salt thereof), e.g., as measured by an assay described herein, e.g., a Western blot analysis or a flow cytometry analysis. In some embodiments, the fusion polypeptide or the cell is contacted with COF1 (e.g., lenalidomide or pomalidomide, or a pharmaceutically acceptable salt thereof) ex vivo. In some embodiments, the fusion polypeptide or the cell is contacted with COF1 (e.g., lenalidomide or pomalidomide, or a pharmaceutically acceptable salt thereof) in vivo.

In one aspect, disclosed herein is a method of regulating the expression of a fusion polypeptide disclosed herein (e.g., a fusion polypeptide comprising a COF1/CRBN- or COF2/CRBN-binding polypeptide, a heterologous polypeptide (e.g., a CAR polypeptide), and a degradation domain), comprising:
   i) contacting the fusion polypeptide or a cell comprising the fusion polypeptide with a stabilization compound, optionally wherein in the presence of the stabilization compound:
      a) the degradation domain assumes a conformation more resistant to cellular degradation relative to a conformation in the absence of the stabilization compound;
      b) the conformation of the fusion polypeptide is more permissive to cleavage at the heterologous protease cleavage site relative to a conformation in the absence of the stabilization compound; or
      c) the expression level of the fusion polypeptide is increased by at least, e.g., 1.5-, 2-, 3-, 4-, 5-, 10-, 20-, 30-, 40-, or 50-fold, compared to the expression level of the fusion polypeptide in the absence of the stabilization compound, e.g., as measured by an assay described herein, e.g., a Western blot analysis or a flow cytometry analysis.

In some embodiments, the method further comprises, after step i):
   ii) contacting the fusion polypeptide or a cell comprising the fusion polypeptide with COF1 (e.g., lenalidomide or pomalidomide, or a pharmaceutically acceptable salt thereof) or COF2 (e.g., lenalidomide or pomalidomide, or a pharmaceutically acceptable salt thereof), optionally wherein in the presence of COF1 or COF2, the expression level of the fusion polypeptide is substantially decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide after step i) and before step ii), e.g., as measured by an assay described herein, e.g., a Western blot analysis or a flow cytometry analysis.

In some embodiments, the stabilization compound is bazedoxifene, or a pharmaceutically acceptable salt thereof. In some embodiments, the degradation domain comprises the amino acid sequence of SEQ ID NO: 46.

In some embodiments, the fusion polypeptide or the cell is contacted with COF1 or COF2 (e.g., lenalidomide or pomalidomide, or a pharmaceutically acceptable salt thereof) and/or the stabilization compound ex vivo. In some embodiments, the fusion polypeptide or the cell is contacted with COF1 or COF2 (e.g., lenalidomide or pomalidomide, or a pharmaceutically acceptable salt thereof) and/or the stabilization compound in vivo.

In some embodiments, the heterologous polypeptide is a chimeric antigen receptor (CAR). In some embodiments, the CAR comprises, in a N-terminal to C-terminal direction, an antigen binding domain, a transmembrane domain, and one or more intracellular signaling domains.

In one aspect, disclosed herein is a method of making a cell, comprising:
  i) providing a cell comprising a nucleic acid molecule encoding a fusion polypeptide comprising a compound of formula 1 (COF1)/CRBN-binding polypeptide and a chimeric antigen receptor (CAR), optionally wherein the CAR comprises, in a N-terminal to C-terminal direction, an antigen binding domain, a transmembrane domain, and one or more intracellular signaling domains; and
  ii) contacting the cell ex vivo with COF1, optionally wherein:
  in the presence of COF1, the expression level of the fusion polypeptide is substantially decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide in the absence of COF1, e.g., as measured by an assay described herein, e.g., a Western blot analysis or a flow cytometry analysis, wherein the compound of Formula (I) is:

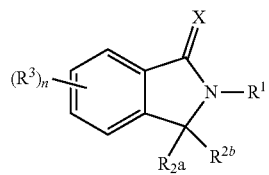

(I)

or a pharmaceutically acceptable salt, ester, hydrate, solvate, or tautomer thereof, wherein:
  X is O or S;
  $R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by one or more $R^4$;
  each of $R^{2a}$ and $R^{2b}$ is independently hydrogen or $C_1$-$C_6$ alkyl; or $R^{2a}$ and $R^{2b}$ together with the carbon atom to which they are attached form a carbonyl group or a thiocarbonyl group;
  each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$($R^E$, —S(O)$_x$N($R^C$)($R^D$), or —N($R^C$)S(O)$_x$$R^E$, wherein each alkyl, alkenyl, alkynyl, and heteroalkyl is independently and optionally substituted with one or more $R^6$;
  each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), —N($R^C$)S(O)$_x$$R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^7$;
  each of $R^A$, $R^B$, $R^C$, $R^D$, and $R^E$ is independently hydrogen or $C_1$-$C_6$ alkyl;
  each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with one or more $R^8$;
  each $R^7$ is independently halo, oxo, cyano, —O$R^B$, —N($R^C$)($R^D$), —C(O)N($R^C$)($R^D$), or —N($R^C$)C(O)$R^A$;
  each $R^8$ is independently $C_1$-$C_6$ alkyl, cyano, —O$R^B$, —N($R^C$)($R^D$), —C(O)N($R^C$)($R^D$), or —N($R^C$)C(O)$R^A$;
  n is 0, 1, 2, 3 or 4; and
  x is 0, 1, or 2.

In some embodiments, after the cell is contacted with COF1 ex vivo, the proliferation of the cell is increased by at least, e.g., 1.2-, 1.5-, 2-, 5-, or 10-fold, relative to the proliferation of the cell prior to the contacting with COF1. In some embodiments, COF1 is lenalidomide or pomalidomide, or a pharmaceutically acceptable salt thereof. In some embodiments, the COF1/CRBN-binding polypeptide comprises or consists of an amino acid sequence selected from the group consisting of SEQ ID NOs: 1-6, 11-15, 40, 41-43, 77, 78, 84-86, and 100 (e.g., the COF1/CRBN-binding polypeptide comprises or consists of the amino acid sequence of SEQ ID NO: 3).

In one aspect, provided herein is a method of treating a subject having a disease associated with expression of a tumor antigen, comprising:
  i) contacting a cell disclosed herein (e.g., a cell comprising a fusion polypeptide comprising a COF1/CRBN-binding polypeptide and a heterologous polypeptide (e.g., a CAR polypeptide)) with COF1 ex vivo, optionally wherein:
  in the presence of COF1, the expression level of the fusion polypeptide is decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide before the cell is contacted with COF1 ex vivo, and
  ii) administering to the subject an effective amount of the cell, optionally wherein the method further comprises after step i) and prior to step ii):
  reducing the amount of COF1 contacting the cell, e.g., inside and/or surrounding the cell,
  thereby treating the disease.

In some embodiments, the method further comprises after step ii):
  iii) administering to the subject an effective amount of COF1, optionally wherein the administration of COF1 decreases, e.g., by at least about 1, 2, 3, 4, 5, 6, 7, 8, 9, 10, 20, 30, 40, 50, 60, 70, 80, 90, or 100 percent, the expression level of the fusion polypeptide relative to the expression level of the fusion polypeptide after step ii) and prior to step iii), optionally wherein:
  a) the subject has developed, is developing, or is anticipated to develop an adverse reaction,
  b) the administration of COF1 is in response to an occurrence of an adverse reaction in the subject, or in response to an anticipation of an occurrence of an adverse reaction in the subject, and/or
  c) the administration of COF1 reduces or prevents an adverse effect.

In some embodiments, the method further comprises after step iii):
- iv) discontinuing the administration of COF1, optionally wherein discontinuing the administration of COF1 increases, e.g., by at least about 1.5-, 2-, 3-, 4-, 5-, 10-, 20-, 30-, 40-, or 50-fold, the expression level of the fusion polypeptide relative to the expression level of the fusion polypeptide after step iii) and prior to step iv) (e.g., wherein discontinuing the administration of COF1 restores the expression level of the fusion polypeptide to the expression level after step ii) and prior to step iii)), optionally wherein:
  - a) the subject has relapsed, is relapsing, or is anticipated to relapse,
  - b) the discontinuation of the administration of COF1 is in response to a tumor relapse in the subject, or in response to an anticipation of a relapse in the subject, and/or
  - c) the discontinuation of the administration of COF1 treats or prevents a tumor relapse.

In some embodiments, the method further comprises after step iv):
- v) repeating step iii) and/or iv),
- thereby treating the disease.

In some embodiments, COF1 is lenalidomide or pomalidomide, or a pharmaceutically acceptable salt thereof, optionally wherein the COF1/CRBN-binding polypeptide comprises or consists of an amino acid sequence selected from the group consisting of SEQ ID NOs: 1-6, 11-15, 40, 41-43, 77, 78, 84-86, and 100 (e.g., the COF1/CRBN-binding polypeptide comprises or consists of the amino acid sequence of SEQ ID NO: 3). In some embodiments, COF1 is lenalidomide, or a pharmaceutically acceptable salt thereof, optionally wherein lenalidomide, or a pharmaceutically acceptable salt thereof, is administered at, e.g., 2.5 mg, 5 mg, 10 mg, 15 mg, or 25 mg per day.

In one aspect, provided herein is a method of treating a subject having a disease associated with expression of a tumor antigen, comprising:
- i) administering to the subject an effective amount of a cell disclosed herein (e.g., a cell comprising a fusion polypeptide comprising a COF1/CRBN-binding polypeptide and a heterologous polypeptide (e.g., a CAR polypeptide)), optionally wherein the cell is contacted with COF1 ex vivo before administration, optionally wherein:
- in the presence of COF1, the expression level of the fusion polypeptide is decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide before the cell is contacted with COF1 ex vivo, optionally wherein after the cell is contacted with COF1 ex vivo and before the cell is administered to the subject, the amount of COF1 contacting the cell, e.g., inside and/or surrounding the cell, is reduced,
- thereby treating the disease.

In some embodiments, the cell is not contacted with COF1 ex vivo before administration.

In some embodiments, the method further comprises after step i):
- ii) administering to the subject an effective amount of COF1, optionally wherein the administration of COF1 decreases, e.g., by at least about 1, 2, 3, 4, 5, 6, 7, 8, 9, 10, 20, 30, 40, 50, 60, 70, 80, 90, or 100 percent, the expression level of the fusion polypeptide relative to the expression level of the fusion polypeptide after step i) and prior to step ii), optionally wherein:
  - a) the subject has developed, is developing, or is anticipated to develop an adverse reaction,
  - b) the administration of COF1 is in response to an occurrence of an adverse reaction in the subject, or in response to an anticipation of an occurrence of an adverse reaction in the subject, and/or
  - c) the administration of COF1 reduces or prevents an adverse effect.

In some embodiments, the method further comprises after step ii):
- iii) discontinuing the administration of COF1, optionally wherein discontinuing the administration of COF1 increases, e.g., by at least about 1.5-, 2-, 3-, 4-, 5-, 10-, 20-, 30-, 40-, or 50-fold, the expression level of the fusion polypeptide relative to the expression level of the fusion polypeptide after step ii) and prior to step iii) (e.g., wherein discontinuing the administration of COF1 restores the expression level of the fusion polypeptide to the expression level after step i) and prior to step ii)), optionally wherein:
  - a) the subject has relapsed, is relapsing, or is anticipated to relapse,
  - b) the discontinuation of the administration of COF1 is in response to a tumor relapse in the subject, or in response to an anticipation of a relapse in the subject, and/or
  - c) the discontinuation of the administration of COF1 treats or prevents a tumor relapse.

In some embodiments, the method further comprises after step iii):
- iv) repeating step ii) and/or iii),
- thereby treating the disease.

In some embodiments, COF1 is lenalidomide or pomalidomide, or a pharmaceutically acceptable salt thereof, optionally wherein the COF1/CRBN-binding polypeptide comprises or consists of an amino acid sequence selected from the group consisting of SEQ ID NOs: 1-6, 11-15, 40, 41-43, 77, 78, 84-86, and 100 (e.g., the COF1/CRBN-binding polypeptide comprises or consists of the amino acid sequence of SEQ ID NO: 3). In some embodiments, COF1 is lenalidomide, or a pharmaceutically acceptable salt thereof, optionally wherein lenalidomide, or a pharmaceutically acceptable salt thereof, is administered at, e.g., 2.5 mg, 5 mg, 10 mg, 15 mg, or 25 mg per day.

In one aspect, provided herein is a method of treating a subject having a disease associated with expression of a tumor antigen, comprising:
- i) administering an effective amount of COF1 to the subject, wherein the subject comprises a cell disclosed herein (e.g., a cell comprising a fusion polypeptide comprising a COF1/CRBN-binding polypeptide and a heterologous polypeptide (e.g., a CAR polypeptide)), optionally wherein the administration of COF1 decreases, e.g., by at least about 1, 2, 3, 4, 5, 6, 7, 8, 9, 10, 20, 30, 40, 50, 60, 70, 80, 90, or 100 percent, the expression level of the fusion polypeptide relative to the expression level of the fusion polypeptide before the administration of COF1, optionally wherein:
  - a) the subject has developed, is developing, or is anticipated to develop an adverse reaction,
  - b) the administration of COF1 is in response to an occurrence of an adverse reaction in the subject, or in response to an anticipation of an occurrence of an adverse reaction in the subject, and/or c) the administration of COF1 reduces or prevents an adverse effect.

In some embodiments, the method further comprises after step i):
ii) discontinuing the administration of COF1, optionally wherein discontinuing the administration of COF1 increases, e.g., by at least about 1.5-, 2-, 3-, 4-, 5-, 10-, 20-, 30-, 40-, or 50-fold, the expression level of the fusion polypeptide relative to the expression level of the fusion polypeptide after step i) and prior to step ii) (e.g., wherein discontinuing the administration of COF1 restores the expression level of the fusion polypeptide to the expression level before the administration of COF1), optionally wherein:
a) the subject has relapsed, is relapsing, or is anticipated to relapse,
b) the discontinuation of the administration of COF1 is in response to a tumor relapse in the subject, or in response to an anticipation of a relapse in the subject, and/or
c) the discontinuation of the administration of COF1 treats or prevents a tumor relapse.

In some embodiments, the method further comprises after step ii):
iii) repeating step i) and/or ii),
thereby treating the disease.

In some embodiments, COF1 is lenalidomide or pomalidomide, or a pharmaceutically acceptable salt thereof, optionally wherein the COF1/CRBN-binding polypeptide comprises or consists of an amino acid sequence selected from the group consisting of SEQ ID NOs: 1-6, 11-15, 40, 41-43, 77, 78, 84-86, and 100 (e.g., the COF1/CRBN-binding polypeptide comprises or consists of the amino acid sequence of SEQ ID NO: 3). In some embodiments, COF1 is lenalidomide, or a pharmaceutically acceptable salt thereof, optionally wherein lenalidomide, or a pharmaceutically acceptable salt thereof, is administered at, e.g., 2.5 mg, 5 mg, 10 mg, 15 mg, or 25 mg per day.

In one aspect, provided herein is a method of treating a subject having a disease associated with expression of a tumor antigen, comprising:
i) administering to the subject:
(1) a stabilization compound, and
(2) an effective amount of a cell disclosed herein (e.g., a cell comprising a fusion polypeptide comprising a COF1/CRBN- or COF2/CRBN-binding polypeptide, a heterologous polypeptide (e.g., a CAR polypeptide), and a degradation domain), optionally wherein:
the expression level of the fusion polypeptide in the presence of the stabilization compound is e.g., at least about 1.5-, 2-, 3-, 4-, 5-, 10-, 20-, 30-, 40-, or 50-fold, higher than the expression level of the fusion polypeptide in the absence of the stabilization compound,
thereby treating the disease.

In some embodiments, the method further comprises after step i):
ii) discontinuing the administration of the stabilization compound, optionally wherein discontinuing the administration of the stabilization compound reduces, e.g., at least about 1.5-, 2-, 3-, 4-, 5-, 10-, 20-, 30-, 40-, or 50-fold, the expression level of the fusion polypeptide relative to the expression of the fusion polypeptide after step i) and prior to step ii), optionally wherein:
a) the subject responded to the treatment of step i) (e.g., the subject has a complete response to the treatment of step i), the subject shows a shrinkage in tumor mass, the subject shows a decrease in tumor cells, or the treatment of step i) is effective in the subject), and/or
b) the discontinuation of the administration of the stabilization compound is in response to a response of the subject to the treatment of step i) (e.g., the subject has a complete response to the treatment of step i), the subject shows a shrinkage in tumor mass, the subject shows a decrease in tumor cells, or the treatment of step i) is effective in the subject).

In some embodiments, the method further comprises after step i):
iii) discontinuing the administration of the stabilization compound, optionally wherein discontinuing the administration of the stabilization compound reduces, e.g., at least about 1.5-, 2-, 3-, 4-, 5-, 10-, 20-, 30-, 40-, or 50-fold, the expression level of the fusion polypeptide relative to the expression of the fusion polypeptide after step i) and prior to step ii), optionally wherein:
a) the subject has developed, is developing, or is anticipated to develop an adverse reaction,
b) the discontinuation of the administration of the stabilization compound is in response to an occurrence of an adverse reaction in the subject, or in response to an anticipation of an occurrence of an adverse reaction in the subject, and/or
c) the discontinuation of the administration of the stabilization compound reduces or prevents an adverse effect.

In some embodiments, the method further comprises after step i):
iv) discontinuing the administration of the stabilization compound and administering to the subject an effective amount of COF1 or COF2, optionally wherein step iv) reduces, e.g., at least about 1.5-, 2-, 3-, 4-, 5-, 10-, 20-, 30-, 40-, or 50-fold, the expression level of the fusion polypeptide relative to the expression of the fusion polypeptide after step i) and prior to step iv), optionally wherein:
a) the subject has developed, is developing, or is anticipated to develop an adverse reaction,
b) step iv) is in response to an occurrence of an adverse reaction in the subject, or in response to an anticipation of an occurrence of an adverse reaction in the subject, and/or
c) step iv) reduces or prevents an adverse effect. In some embodiments, the adverse effect is an acute toxicity.

In some embodiments, the method further comprises after step iv):
v) discontinuing the administration of COF1 or COF2, e.g., after the amount of cells expressing the fusion polypeptide on the surface is smaller than a pre-defined value, for, e.g., 1 day, 5 days, 10 days, or 15 days.

In some embodiments, the method further comprises after step ii), iii), iv), or v):
vi) administering an effective amount of a stabilization compound, optionally wherein the administration of the stabilization compound increases, e.g., by at least about 1.5-, 2-, 3-, 4-, 5-, 10-, 20-, 30-, 40-, or 50-fold, the expression level of the fusion polypeptide relative to the expression level of the fusion polypeptide after step ii), iii), iv), or v) and prior to step vi), optionally wherein:
a) the subject has relapsed, is relapsing, or is anticipated to relapse, b) the administration of the stabilization compound is in response to a tumor relapse in the subject, or in response to an anticipation of a relapse in the subject, and/or c) the administration of the stabilization compound treats or prevents a tumor relapse.

In some embodiments, the method further comprises after step vi):

vii) repeating step iii), iv), v), or vi), thereby treating the disease.

In some embodiments, the method further comprises prior to step i):

viii) contacting the cell with a stabilization compound ex vivo, optionally wherein the expression level of the fusion polypeptide in the presence of the stabilization compound is e.g., at least about 1.5-, 2-, 3-, 4-, 5-, 10-, 20-, 30-, 40-, or 50-fold, higher than the expression level of the fusion polypeptide in the absence of the stabilization compound.

In some embodiments, the cell is not contacted with the stabilization compound ex vivo before administration. In some embodiments, the cell is not contacted with any of: the stabilization compound, COF1, or COF2 ex vivo before administration.

In some embodiments, the stabilization compound is bazedoxifene, or a pharmaceutically acceptable salt thereof, and optionally wherein the degradation domain comprises the amino acid sequence of SEQ ID NO: 46.

In some embodiments, COF1 is lenalidomide or pomalidomide, or a pharmaceutically acceptable salt thereof, optionally wherein the COF1/CRBN-binding polypeptide comprises or consists of an amino acid sequence selected from the group consisting of SEQ ID NOs: 1-6, 11-15, 40, 41-43, 77, 78, 84-86, and 100 (e.g., the COF1/CRBN-binding polypeptide comprises or consists of the amino acid sequence of SEQ ID NO: 3).

In some embodiments, COF2 is lenalidomide or pomalidomide, or a pharmaceutically acceptable salt thereof, optionally wherein the COF2/CRBN-binding polypeptide comprises or consists of an amino acid sequence selected from the group consisting of SEQ ID NOs: 1-6, 11-15, 40, 41-43, 77, 78, 84-86, and 100 (e.g., the COF1/CRBN-binding polypeptide comprises or consists of the amino acid sequence of SEQ ID NO: 3).

In some embodiments, COF1 or COF2 is lenalidomide, or a pharmaceutically acceptable salt thereof, optionally wherein lenalidomide, or a pharmaceutically acceptable salt thereof, is administered at, e.g., 2.5 mg, 5 mg, 10 mg, 15 mg, or 25 mg per day.

In one aspect, disclosed herein is a method of degrading a fusion polypeptide disclosed herein (e.g., a fusion polypeptide comprising a COF3/CRBN-binding polypeptide and a heterologous polypeptide (e.g., a CAR polypeptide)), comprising contacting the fusion polypeptide or a cell comprising said fusion polypeptide with COF3 (e.g., a compound disclosed in Table 29, or a pharmaceutically acceptable salt thereof). In one embodiment, in the presence of COF3, the expression level of said fusion polypeptide is substantially decreased, e.g., by at least about 1, 2, 3, 4, 5, 6, 7, 8, 9, 10, 20, 30, 40, 50, 60, 70, 80, 90, or 100 percent, relative to the expression level of said fusion polypeptide in the absence of COF3, e.g., as measured by an assay described herein, e.g., a Western blot analysis or a flow cytometry analysis. In one embodiment, the fusion polypeptide or the cell is contacted with COF3 ex vivo. In one embodiment, the fusion polypeptide or the cell is contacted with COF3 in vivo.

In one aspect, disclosed herein is a method of regulating the expression of a fusion polypeptide disclosed herein (e.g., a fusion polypeptide comprising a COF3/CRBN-binding polypeptide, a heterologous polypeptide (e.g., a CAR polypeptide), and a degradation domain), comprising:

i) contacting the fusion polypeptide or a cell comprising the fusion polypeptide with a stabilization compound, optionally wherein in the presence of the stabilization compound:

a) the degradation domain assumes a conformation more resistant to cellular degradation relative to a conformation in the absence of the stabilization compound;

b) the conformation of the fusion polypeptide is more permissive to cleavage at the heterologous protease cleavage site relative to a conformation in the absence of the stabilization compound; or c) the expression level of the fusion polypeptide is increased by at least, e.g., 1.5-, 2-, 3-, 4-, 5-, 10-, 20-, 30-, 40-, or 50-fold, compared to the expression level of the fusion polypeptide in the absence of the stabilization compound, e.g., as measured by an assay described herein, e.g., a Western blot analysis or a flow cytometry analysis.

In some embodiments, the method further comprises, after step i):

ii) contacting the fusion polypeptide or a cell comprising the fusion polypeptide with COF3 (e.g., a compound disclosed in Table 29, or a pharmaceutically acceptable salt thereof), optionally wherein in the presence of COF3, the expression level of the fusion polypeptide is substantially decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide after step i) and before step ii), e.g., as measured by an assay described herein, e.g., a Western blot analysis or a flow cytometry analysis.

In some embodiments, the fusion polypeptide or the cell is contacted with COF3 ex vivo. In some embodiments, the fusion polypeptide or the cell is contacted with COF3 in vivo. In some embodiments, the stabilization compound is bazedoxifene, or a pharmaceutically acceptable salt thereof. In some embodiments, the degradation domain comprises the amino acid sequence of SEQ ID NO: 46.

In one aspect, disclosed herein is a method of making a cell, comprising:

i) providing a cell comprising a nucleic acid molecule encoding a fusion polypeptide comprising a COF3/CRBN-binding polypeptide and a chimeric antigen receptor (CAR), optionally wherein the CAR comprises, in a N-terminal to C-terminal direction, an antigen binding domain, a transmembrane domain, and one or more intracellular signaling domains; and ii) contacting the cell ex vivo with COF3, optionally wherein:

in the presence of COF3, the expression level of the fusion polypeptide is substantially decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide in the absence of COF3, e.g., as measured by an assay described herein, e.g., a Western blot analysis or a flow cytometry analysis.

In one aspect, provided herein is a method of treating a subject having a disease associated with expression of a tumor antigen, comprising:

i) contacting a cell disclosed herein (e.g., a cell comprising a fusion polypeptide comprising a COF3/CRBN-binding polypeptide and a heterologous polypeptide (e.g., a CAR polypeptide)) with COF3 ex vivo, optionally wherein:
in the presence of COF3, the expression level of the fusion polypeptide is decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide before the cell is contacted with COF3 ex vivo, and
ii) administering to the subject an effective amount of the cell, optionally wherein the method further comprises after step i) and prior to step ii):
reducing the amount of COF3 contacting the cell, e.g., inside and/or surrounding the cell,
thereby treating the disease.

In some embodiments, the method further comprises after step ii):
iii) administering to the subject an effective amount of COF3, optionally wherein the administration of COF3 decreases, e.g., by at least about 1, 2, 3, 4, 5, 6, 7, 8, 9, 10, 20, 30, 40, 50, 60, 70, 80, 90, or 100 percent, the expression level of the fusion polypeptide relative to the expression level of the fusion polypeptide after step ii) and prior to step iii), optionally wherein:
a) the subject has developed, is developing, or is anticipated to develop an adverse reaction,
b) the administration of COF3 is in response to an occurrence of an adverse reaction in the subject, or in response to an anticipation of an occurrence of an adverse reaction in the subject, and/or
c) the administration of COF3 reduces or prevents an adverse effect.

In some embodiments, the method further comprises after step iii):
iv) discontinuing the administration of COF3, optionally wherein discontinuing the administration of COF3 increases, e.g., by at least about 1.5-, 2-, 3-, 4-, 5-, 10-, 20-, 30-, 40-, or 50-fold, the expression level of the fusion polypeptide relative to the expression level of the fusion polypeptide after step iii) and prior to step iv) (e.g., wherein discontinuing the administration of COF3 restores the expression level of the fusion polypeptide to the expression level after step ii) and prior to step iii)), optionally wherein:
a) the subject has relapsed, is relapsing, or is anticipated to relapse,
b) the discontinuation of the administration of COF3 is in response to a tumor relapse in the subject, or in response to an anticipation of a relapse in the subject, and/or
c) the discontinuation of the administration of COF3 treats or prevents a tumor relapse.

In some embodiments, the method further comprises after step iv):
v) repeating step iii) and/or iv),
thereby treating the disease.

In some embodiments, COF3 is a compound disclosed in Table 29, or a pharmaceutically acceptable salt thereof. In some embodiments, the COF3/CRBN-binding polypeptide comprises or consists of the amino acid sequence of SEQ ID NO: 109, or an amino acid sequence with at least 80, 85, 90, or 95% identity thereto.

In one aspect, provided herein is a method of treating a subject having a disease associated with expression of a tumor antigen, comprising:
i) administering to the subject an effective amount of a cell disclosed herein (e.g., a cell comprising a fusion polypeptide comprising a COF3/CRBN-binding polypeptide and a heterologous polypeptide (e.g., a CAR polypeptide)), optionally wherein the cell is contacted with COF3 ex vivo before administration, optionally wherein:
in the presence of COF3, the expression level of the fusion polypeptide is decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide before the cell is contacted with COF3 ex vivo, optionally wherein after the cell is contacted with COF3 ex vivo and before the cell is administered to the subject, the amount of COF3 contacting the cell, e.g., inside and/or surrounding the cell, is reduced,
thereby treating the disease.

In some embodiments, the cell is not contacted with COF3 ex vivo before administration.

In some embodiments, the method further comprises after step i):
ii) administering to the subject an effective amount of COF3, optionally wherein the administration of COF3 decreases, e.g., by at least about 1, 2, 3, 4, 5, 6, 7, 8, 9, 10, 20, 30, 40, 50, 60, 70, 80, 90, or 100 percent, the expression level of the fusion polypeptide relative to the expression level of the fusion polypeptide after step i) and prior to step ii), optionally wherein:
a) the subject has developed, is developing, or is anticipated to develop an adverse reaction,
b) the administration of COF3 is in response to an occurrence of an adverse reaction in the subject, or in response to an anticipation of an occurrence of an adverse reaction in the subject, and/or
c) the administration of COF3 reduces or prevents an adverse effect.

In some embodiments, the method further comprises after step ii):
iii) discontinuing the administration of COF3, optionally wherein discontinuing the administration of COF3 increases, e.g., by at least about 1.5-, 2-, 3-, 4-, 5-, 10-, 20-, 30-, 40-, or 50-fold, the expression level of the fusion polypeptide relative to the expression level of the fusion polypeptide after step ii) and prior to step iii) (e.g., wherein discontinuing the administration of COF3 restores the expression level of the fusion polypeptide to the expression level after step i) and prior to step ii)), optionally wherein:
a) the subject has relapsed, is relapsing, or is anticipated to relapse,
b) the discontinuation of the administration of COF3 is in response to a tumor relapse in the subject, or in response to an anticipation of a relapse in the subject, and/or
c) the discontinuation of the administration of COF3 treats or prevents a tumor relapse.

In some embodiments, the method further comprises after step iii):
iv) repeating step ii) and/or iii),
thereby treating the disease.

In some embodiments, COF3 is a compound disclosed in Table 29, or a pharmaceutically acceptable salt thereof. In some embodiments, the COF3/CRBN-binding polypeptide comprises or consists of the amino acid sequence of SEQ ID NO: 109, or an amino acid sequence with at least 80, 85, 90, or 95% identity thereto.

In one aspect, provided herein is a method of treating a subject having a disease associated with expression of a tumor antigen, comprising:
  i) administering an effective amount of COF3 to the subject, wherein the subject comprises a cell disclosed herein (e.g., a cell comprising a fusion polypeptide comprising a COF3/CRBN-binding polypeptide and a heterologous polypeptide (e.g., a CAR polypeptide)), optionally wherein the administration of COF3 decreases, e.g., by at least about 1, 2, 3, 4, 5, 6, 7, 8, 9, 10, 20, 30, 40, 50, 60, 70, 80, 90, or 100 percent, the expression level of the fusion polypeptide relative to the expression level of the fusion polypeptide before the administration of COF3, optionally wherein:
    a) the subject has developed, is developing, or is anticipated to develop an adverse reaction,
    b) the administration of COF3 is in response to an occurrence of an adverse reaction in the subject, or in response to an anticipation of an occurrence of an adverse reaction in the subject, and/or
    c) the administration of COF3 reduces or prevents an adverse effect.

In some embodiments, the method further comprises after step i):
  ii) discontinuing the administration of COF3, optionally wherein discontinuing the administration of COF3 increases, e.g., by at least about 1.5-, 2-, 3-, 4-, 5-, 10-, 20-, 30-, 40-, or 50-fold, the expression level of the fusion polypeptide relative to the expression level of the fusion polypeptide after step i) and prior to step ii) (e.g., wherein discontinuing the administration of COF3 restores the expression level of the fusion polypeptide to the expression level before the administration of COF3), optionally wherein:
    a) the subject has relapsed, is relapsing, or is anticipated to relapse,
    b) the discontinuation of the administration of COF3 is in response to a tumor relapse in the subject, or in response to an anticipation of a relapse in the subject, and/or
    c) the discontinuation of the administration of COF3 treats or prevents a tumor relapse.

In some embodiments, the method further comprises after step ii):
  iii) repeating step i) and/or ii),
  thereby treating the disease.

In some embodiments, COF3 is a compound disclosed in Table 29, or a pharmaceutically acceptable salt thereof. In some embodiments, the COF3/CRBN-binding polypeptide comprises or consists of the amino acid sequence of SEQ ID NO: 109, or an amino acid sequence with at least 80, 85, 90, or 95% identity thereto.

In one aspect, provided herein is a method of treating a subject having a disease associated with expression of a tumor antigen, comprising:
  i) administering to the subject:
  (1) a stabilization compound, and
  (2) an effective amount of a cell disclosed herein (e.g., a cell comprising a fusion polypeptide comprising a COF3/CRBN-binding polypeptide, a heterologous polypeptide (e.g., a CAR polypeptide), and a degradation domain), optionally wherein:
    the expression level of the fusion polypeptide in the presence of the stabilization compound is e.g., at least about 1.5-, 2-, 3-, 4-, 5-, 10-, 20-, 30-, 40-, or 50-fold, higher than the expression level of the fusion polypeptide in the absence of the stabilization compound,
  thereby treating the disease.

In some embodiments, the method further comprises after step i):
  ii) discontinuing the administration of the stabilization compound, optionally wherein discontinuing the administration of the stabilization compound reduces, e.g., at least about 1.5-, 2-, 3-, 4-, 5-, 10-, 20-, 30-, 40-, or 50-fold, the expression level of the fusion polypeptide relative to the expression of the fusion polypeptide after step i) and prior to step ii), optionally wherein:
    a) the subject responded to the treatment of step i) (e.g., the subject has a complete response to the treatment of step i), the subject shows a shrinkage in tumor mass, the subject shows a decrease in tumor cells, or the treatment of step i) is effective in the subject), and/or
    b) the discontinuation of the administration of the stabilization compound is in response to a response of the subject to the treatment of step i) (e.g., the subject has a complete response to the treatment of step i), the subject shows a shrinkage in tumor mass, the subject shows a decrease in tumor cells, or the treatment of step i) is effective in the subject).

In some embodiments, the method further comprises after step i):
  iii) discontinuing the administration of the stabilization compound, optionally wherein discontinuing the administration of the stabilization compound reduces, e.g., at least about 1.5-, 2-, 3-, 4-, 5-, 10-, 20-, 30-, 40-, or 50-fold, the expression level of the fusion polypeptide relative to the expression of the fusion polypeptide after step i) and prior to step ii), optionally wherein:
    a) the subject has developed, is developing, or is anticipated to develop an adverse reaction,
    b) the discontinuation of the administration of the stabilization compound is in response to an occurrence of an adverse reaction in the subject, or in response to an anticipation of an occurrence of an adverse reaction in the subject, and/or
    c) the discontinuation of the administration of the stabilization compound reduces or prevents an adverse effect.

In some embodiments, the method further comprises after step i):
  iv) discontinuing the administration of the stabilization compound and administering to the subject an effective amount of COF3, optionally wherein step iv) reduces, e.g., at least about 1.5-, 2-, 3-, 4-, 5-, 10-, 20-, 30-, 40-, or 50-fold, the expression level of the fusion polypeptide relative to the expression of the fusion polypeptide after step i) and prior to step iv), optionally wherein:
    a) the subject has developed, is developing, or is anticipated to develop an adverse reaction,
    b) step iv) is in response to an occurrence of an adverse reaction in the subject, or in response to an anticipation of an occurrence of an adverse reaction in the subject, and/or
    c) step iv) reduces or prevents an adverse effect. In some embodiments, the adverse effect is an acute toxicity.

In some embodiments, the method further comprises after step iv):
  v) discontinuing the administration of COF3, e.g., after the amount of cells expressing the fusion polypeptide on the surface is smaller than a pre-defined value, for, e.g., 1 day, 5 days, 10 days, or 15 days.

In some embodiments, the method further comprises after step ii), iii), iv), or v):

vi) administering an effective amount of a stabilization compound, optionally wherein the administration of the stabilization compound increases, e.g., by at least about 1.5-, 2-, 3-, 4-, 5-, 10-, 20-, 30-, 40-, or 50-fold, the expression level of the fusion polypeptide relative to the expression level of the fusion polypeptide after step ii), iii), iv), or v) and prior to step vi), optionally wherein:
 a) the subject has relapsed, is relapsing, or is anticipated to relapse,
 b) the administration of the stabilization compound is in response to a tumor relapse in the subject, or in response to an anticipation of a relapse in the subject, and/or
 c) the administration of the stabilization compound treats or prevents a tumor relapse.

In some embodiments, the method further comprises after step vi):
 vii) repeating step iii), iv), v), or vi),
 thereby treating the disease.

In some embodiments, the method further comprises prior to step i):
 viii) contacting the cell with a stabilization compound ex vivo, optionally wherein the expression level of the fusion polypeptide in the presence of the stabilization compound is e.g., at least about 1.5-, 2-, 3-, 4-, 5-, 10-, 20-, 30-, 40-, or 50-fold, higher than the expression level of the fusion polypeptide in the absence of the stabilization compound.

In some embodiments, the cell is not contacted with the stabilization compound ex vivo before administration.

In some embodiments, the stabilization compound is bazedoxifene, or a pharmaceutically acceptable salt thereof, and optionally wherein the degradation domain comprises the amino acid sequence of SEQ ID NO: 46.

In some embodiments, COF3 is a compound disclosed in Table 29, or a pharmaceutically acceptable salt thereof. In some embodiments, the COF3/CRBN-binding polypeptide comprises or consists of the amino acid sequence of SEQ ID NO: 109, or an amino acid sequence with at least 80, 85, 90, or 95% identity thereto.

In some embodiments, the heterologous polypeptide of the fusion polypeptide is a chimeric antigen receptor (CAR), optionally wherein the CAR comprises, in a N-terminal to C-terminal direction, an antigen binding domain, a transmembrane domain, and one or more intracellular signaling domains.

In one aspect, this invention also provides a fusion polypeptide, nucleic acid molecule, vector, viral particle, cell, or pharmaceutical composition disclosed herein for use as a medicament. In one aspect, this invention also provides a fusion polypeptide, nucleic acid molecule, vector, viral particle, cell, or pharmaceutical composition disclosed herein for use in the treatment of a subject having a disease associated with expression of a tumor antigen.

In certain embodiments of the foregoing methods, the disease associated with expression of a tumor antigen is a cancer.

In some embodiments, the cancer is mesothelioma (e.g., malignant pleural mesothelioma), e.g., in a subject who has progressed on at least one prior standard therapy; lung cancer (e.g., non-small cell lung cancer, small cell lung cancer, squamous cell lung cancer, or large cell lung cancer); pancreatic cancer (e.g., pancreatic ductal adenocarcinoma, or metastatic pancreatic ductal adenocarcinoma (PDA), e.g., in a subject who has progressed on at least one prior standard therapy); esophageal adenocarcinoma, ovarian cancer (e.g., serous epithelial ovarian cancer, e.g., in a subject who has progressed after at least one prior regimen of standard therapy), breast cancer, colorectal cancer, bladder cancer or any combination thereof.

In some embodiments, the disease associated with expression of a tumor antigen is a hematological cancer, e.g., a hematological cancer chosen from a leukemia or lymphoma. In some embodiments, the cancer is chosen from: chronic lymphocytic leukemia (CLL), mantle cell lymphoma (MCL), multiple myeloma, acute lymphoid leukemia (ALL), Hodgkin lymphoma, B-cell acute lymphoid leukemia (BALL), T-cell acute lymphoid leukemia (TALL), small lymphocytic leukemia (SLL), B cell prolymphocytic leukemia, blastic plasmacytoid dendritic cell neoplasm, Burkitt's lymphoma, diffuse large B cell lymphoma (DLBCL), DLBCL associated with chronic inflammation, chronic myeloid leukemia, myeloproliferative neoplasms, follicular lymphoma, pediatric follicular lymphoma, hairy cell leukemia, small cell- or a large cell-follicular lymphoma, malignant lymphoproliferative conditions, MALT lymphoma (extranodal marginal zone lymphoma of mucosa-associated lymphoid tissue), Marginal zone lymphoma, myelodysplasia, myelodysplastic syndrome, non-Hodgkin lymphoma, plasmablastic lymphoma, plasmacytoid dendritic cell neoplasm, Waldenstrom macroglobulinemia, splenic marginal zone lymphoma, splenic lymphoma/leukemia, splenic diffuse red pulp small B-cell lymphoma, hairy cell leukemia-variant, lymphoplasmacytic lymphoma, a heavy chain disease, plasma cell myeloma, solitary plasmocytoma of bone, extraosseous plasmocytoma, nodal marginal zone lymphoma, pediatric nodal marginal zone lymphoma, primary cutaneous follicle center lymphoma, lymphomatoid granulomatosis, primary mediastinal (thymic) large B-cell lymphoma, intravascular large B-cell lymphoma, ALK+ large B-cell lymphoma, large B-cell lymphoma arising in HHV8-associated multicentric Castleman disease, primary effusion lymphoma, B-cell lymphoma, acute myeloid leukemia (AML), or unclassifiable lymphoma.

In some embodiments, the cancer is chosen from MCL, CLL, ALL, Hodgkin lymphoma, AML, or multiple myeloma.

In certain embodiments of the foregoing methods, the cell is autologous to said subject. In certain embodiments of the foregoing methods, the cell is allogenic to said subject. In some embodiments, the cell is a CAR-expressing cell, e.g., a CART cell.

In some embodiments, the subject was administered a cell expressing at least one fusion polypeptide disclosed herein, prior to administration of COF1, COF2, or COF3.

In one aspect, disclosed herein is a method of identifying a genetic element associated with a specific biological phenotype, e.g., a genetic element associated with the development and/or progression of a cancer, the method comprising the steps of:
 i) modulating the expression of a fusion polypeptide disclosed herein (e.g., a fusion polypeptide comprising a COF1/CRBN- or COF3/CRBN-binding polypeptide and a heterologous polypeptide) in cells by exposing said cell to COF1 or COF3, e.g., lenalidomide, or a pharmaceutically acceptable salt thereof,
 (ii) selecting for cells with a phenotype of interest, e.g., a phenotype associated with the development and/or progression of a cancer, and
 (iii) identifying said fusion polypeptide that induces said phenotype of interest, wherein exposure of said cell to COF1 or COF3, e.g., lenalidomide, or a pharmaceutically acceptable salt thereof, decreases, e.g., by at least about 1, 2, 3, 4, 5, 6, 7, 8, 9, 10, 20, 30, 40, 50, 60, 70, 80, 90, or 100 percent, the expression level of said fusion polypeptide relative to the expression level of said fusion polypeptide prior to exposure to COF1 or COF3, e.g., lenalidomide, or a pharmaceutically acceptable salt thereof.

In one aspect, disclosed herein is a method of identifying a genetic element associated with a specific biological phenotype, e.g., a genetic element associated with the development and/or progression of a cancer, the method comprising the steps of:
i) modulating the expression of a fusion polypeptide disclosed herein (e.g., a fusion polypeptide comprising a COF1/CRBN-, COF2/CRBN-, or COF3/CRBN-binding polypeptide, a heterologous polypeptide, and a degradation domain) in cells by exposing said cell to a stabilization compound, e.g., bazedoxifene, or a pharmaceutically acceptable salt thereof, and then to COF1, COF2, or COF3, e.g., lenalidomide, or a pharmaceutically acceptable salt thereof,
(ii) selecting for cells with a phenotype of interest, e.g., a phenotype associated with the development and/or progression of a cancer, and
(iii) identifying said fusion polypeptide that induces said phenotype of interest,
wherein exposure of said cell to the stabilization compound, e.g., bazedoxifene, or a pharmaceutically acceptable salt thereof, increases, e.g., by at least about 1.5-, 2-, 3-, 4-, 5-, 10-, 20-, 30-, 40-, or 50-fold, the expression level of the fusion polypeptide relative to the expression level of the fusion polypeptide prior to exposure to the stabilization compound, e.g., bazedoxifene, or a pharmaceutically acceptable salt thereof, and wherein exposure of said cell to COF1, COF2, or COF3, e.g., lenalidomide, or a pharmaceutically acceptable salt thereof, decreases, e.g., by at least about 1, 2, 3, 4, 5, 6, 7, 8, 9, 10, 20, 30, 40, 50, 60, 70, 80, 90, or 100 percent, the expression level of said fusion polypeptide relative to the expression level of said fusion polypeptide after exposure to the stabilization compound and prior to exposure to COF1 or COF2 (such as thalidomide and derivatives thereof (e.g., lenalidomide, pomalidomide, and thalidomide)), or COF3 (e.g., a compound disclosed in Table 29).

In certain embodiments of the foregoing aspects, the heterologous polypeptide is a chimeric antigen receptor (CAR) polypeptide. In some embodiments, the CAR polypeptide comprises an amino acid sequence disclosed herein, e.g., an amino acid sequence disclosed in Table 3. In some embodiments, the CAR polypeptide is an anti-CD19 CAR polypeptide and comprises an amino acid sequence disclosed herein, e.g., an amino acid sequence disclosed in any of: Table 5, Table 6, Table 7, and Table 30. In some embodiments, the CAR polypeptide is an anti-CD123 CAR polypeptide and comprises an amino acid sequence disclosed herein, e.g., an amino acid sequence disclosed in any of: Table 8, Table 9, Table 10, Table 11, Table 12, Table 13, and Table 14. In some embodiments, the CAR polypeptide is an anti-BCMA CAR polypeptide and comprises an amino acid sequence disclosed herein, e.g., an amino acid sequence disclosed in any of: Table 15, Table 16, Table 17, Table 18, and Table 31. In some embodiments, the CAR polypeptide is an anti-CD22 CAR polypeptide and comprises an amino acid sequence disclosed herein, e.g., an amino acid sequence disclosed in any of: Table 19 and Table 20. In some embodiments, the CAR polypeptide is an anti-CD20 CAR polypeptide and comprises an amino acid sequence disclosed herein, e.g., an amino acid sequence disclosed in Table 32. In some embodiments, the CAR polypeptide is an anti-EGFRvIII CAR polypeptide and comprises an amino acid sequence disclosed herein, e.g., an amino acid sequence disclosed in Table 33. In some embodiments, the CAR polypeptide is an anti-mesothelin CAR polypeptide and comprises an amino acid sequence disclosed herein, e.g., an amino acid sequence disclosed in Table 34.

In certain embodiments of the foregoing aspects, the fusion polypeptide comprises an amino acid sequence disclosed herein, e.g., an amino acid sequence disclosed in Table 4 or Table 28.

In certain embodiments of the foregoing aspects, the COF1/CRBN-, COF2/CRBN-, or COF3/CRBN-binding polypeptide comprises an amino acid sequence disclosed herein, e.g., an amino acid sequence disclosed in Table 1.

In certain embodiments of the foregoing aspects, the degradation domain comprises an amino acid sequence disclosed herein, e.g., an amino acid sequence disclosed in Table 22.

In certain embodiments of the foregoing aspects, the heterologous protease cleavage site comprises an amino acid sequence disclosed herein, e.g., an amino acid sequence disclosed in Table 23.

BRIEF DESCRIPTION OF THE DRAWINGS

FIGS. 6A and 6B are Western blot graphs showing lenalidomide-dependent degradation of MITF tagged with IKZF3 136-180 and 236-249 (FIG. 6A) or IKZF3 136-180 and 236-249 in which every lysine residue in the tag was mutated to arginine ("lysine free IKZF3 136-180 and 236-249") (FIG. 6B). HEK293T cells expressing the tagged MITF fusions using pNL1.1CMV constructs were treated with various concentrations of lenalidomide for 24 hours. The IC50 is approximately 10 nM for IKZF3 136-180 and 236-249-tagged MITF (FIG. 6A) and is below 100 nM for lysine free IKZF3 136-180 and 236-249-tagged MITF (FIG. 6B). In both cases, lenalidomide-dependent degradation was dependent on proteasome as the degradation could be blocked by the proteasome inhibitor, MG132. This data suggests that MITF, rather than the IKZF3 degron tag, was being ubiquitinated. FIG. 6C is a Western blot showing lenalidomide-dependent degradation of lysine free IKZF3 136-180 and 236-249-tagged MITF. HEK293T cells expressing the tagged MITF fusion using a pNL1.1CMV construct was treated with 10 μM lenalidomide for 2 hours, 4 hours, 8 hours, or 24 hours. FIG. 6D is a Western blot of IKZF3 136-180 and 236-249-tagged MITF (left panel) as well as lysine free IKZF3 136-180 and 236-249-tagged MITF (right panel). HEK293T cells expressing the tagged MITF fusions using the pNL1.1CMV constructs were treated with 10 μM of either lenalidomide, pomalidomide, thalidomide, a negative control IMiD that can bind to CRBN, but not IKZF1 or IKZF3, or DMSO for 24 hours before the cells were subjected to Western blot analysis. Pomalidomide mediated the degradation of the tagged MITF to a slightly greater extent than lenalidomide, whereas thalidomide was much less effective in mediating such degradation.

In FIG. 9B, degradation of IKZF3 136-180 and 236-249-tagged CD19 shows an IC50 of approximate 100 nM and strong degradation was detected at 6 hours. The degradation of IKZF3 136-180 and 236-249-tagged CD3zeta shown in FIG. 9C is weaker than that of IKZF3 136-180 and 236-249-tagged CD19. The degradation of tagged CD3zeta was evident after cells were treated with 10 μM of lenalidomide for 24 hours. The degradation of IKZF3 136-180 and 236-249-tagged CD8/CD3zeta shown in FIG. 9D is stronger than that of IKZF3 136-180 and 236-249-tagged CD3zeta.

FIGS. 12A, 12B, and 12C are schematics showing regulation of CAR molecules fused to FurON (FIG. 12A), HilD (FIG. 12B), or both FurON and HilD (FIG. 12C). As shown in FIG. 12A, a CAR fused to FurON can be turned on by administering a stabilization compound (e.g., a small molecule ligand that binds to and stabilizes the degradation domain, e.g., bazedoxifene (BZA)) or turned off by withdrawing the stabilization compound. As shown in FIG. 12B, a CAR fused to the HilD tag can be turned off by administering an IMiD compound (e.g., lenalidomide or pomalidomide) and turned on again by stopping the administration of the IMiD compound. As shown in FIG. 12C, a CAR fused to both FurON and the HilD tag can be turned on by administering the stabilization compound, turned off by discontinuing the stabilization compound and administering an IMiD compound, and turned on again by discontinuing the IMiD compound and administering the stabilization compound. Combining the FurON switch and the HilD switch adds additional layers of regulation to the expression and activity of a CAR molecule.

FIGS. 13A, 13B, and 13C are Western blot graphs showing lenalidomide-dependent degradation of CAR molecules. JNL cells expressing construct 765 (FurON_CAR19) (FIG. 13A), construct 766 (FurON_CAR19_16GS_HilD tag_V5) (FIG. 13B), or construct 767 (FurON_CAR19_16GS_HilD tag) (FIG. 13C) were incubated in the presence 10 μM of lenalidomide ("+") or DMSO ("−") for 24 hours before Western blot analysis. All the samples received 1 μM Bazedoxifene. "A" represents cells transduced with 275 μL of viral supernatant. "B" represents cells transduced with 700 μL of viral supernatant.

FIGS. 14A, 14B, 14C, and 14D are Western blot graphs showing lenalidomide-dependent degradation of CAR molecules. JNL cells expressing construct 771 (CAR19_HilD tag_V5) (FIG. 14A), construct 769 (CAR19_16GS_HilD tag) (FIG. 14B), construct 768 (CAR19_16GS_HilD tag_V5) (FIG. 14C), or construct 770 (CAR19_16GS_HilD tag_NoK) were incubated in the presence 10 μM of lenalidomide ("+") or DMSO ("−") for 24 hours before Western blot analysis. "A" represents cells transduced with 275 μL of viral supernatant. "B" represents cells transduced with 700 μL of viral supernatant.

FIG. 15A shows time-course of 10 μM lenalidomide treatment. FIG. 15B shows a dose-response of lenalidomide at 24 hours.

FIGS. 18A, 18B, 18C, and 18D are a set of flow cytometry histograms showing surface CAR expression in the presence or absence of various concentrations of lenalidomide. Constructs tested include: construct 769 (CAR19_16GS_HilD tag) (FIGS. 18A and 18C) and construct 770 (CAR19_16GS_HilD tag_NoK) (FIGS. 18B and 18D). JNL cells expressing the indicated constructs were incubated in the presence or absence of lenalidomide for 4 hours (FIGS. 18A and 18B) or 20 hours (FIGS. 18C and 18D) prior to flow cytometry analysis.

FIG. 19A is a set of graphs showing luminescence signals from a study where JNL cells expressing construct 769 (CAR19_16GS_HilD tag) (9000 or 12000 cells/well) were treated with 10 μM lenalidomide for 4 hours or 24 hours and then incubated with Nalm6 cells, CD19-expressing K562 cells ("K562+CD19"), K562 cells, or media (no cells) for 4 hours, 8 hours, or 20 hours. FIG. 19B is a set of graphs showing a subset of data from the study described in FIG. 19A: JNL cells expressing construct 769 (CAR19_16GS_HilD tag) (9000 cells/well) were treated with 10 μM lenalidomide for 4 hours and then incubated with Nalm6 cells, CD19-expressing K562 cells ("K562+CD19"), K562 cells, or media (no cells) for 20 hours. The y-axis in FIG. 19B shows luminescence signals after the background signals (signals from the media sample) were subtracted. In both FIGS. 19A and 19B, the two bars in each graph represent samples treated with DMSO ("DMSO") and samples treated with lenalidomide ("Lenalidomide (10 μM)"), respectively.

FIG. 20A is a set of graphs showing luminescence signals from a study where JNL cells expressing construct 767 (FurON_CAR19_16GS_HilD tag) (9000 or 12000 cells/well) were treated with 10 μM lenalidomide for 4 hours or 24 hours and then incubated with Nalm6 cells, CD19-expressing K562 cells ("K562+CD19"), K562 cells, or media (no cells) for 4 hours, 8 hours, or 20 hours. FIG. 20B is a set of graphs showing a subset of data from the study described in FIG. 20A: JNL cells expressing construct 767 (FurON_CAR19_16GS_HilD tag) (9000 cells/well) were treated with 10 lenalidomide for 4 hours and then incubated with Nalm6 cells, CD19-expressing K562 cells ("K562+CD19"), K562 cells, or media (no cells) for 20 hours. The y-axis in FIG. 20B shows luminescence signals after the background signals (signals from the media sample) were subtracted. In both FIGS. 20A and 20B, the four bars in each graph represent samples treated with neither lenalidomide nor bazedoxifene ("DMSO>>DMSO"), samples treated with bazedoxifene but not lenalidomide ("DMSO>>BZA (1 μM)"), samples treated with lenalidomide but not bazedoxifene ("Lenalidomide (10 μM)>>DMSO"), and samples treated with both lenalidomide and bazedoxifene ("Lenalidomide (10 μM)>>BZA (1 μM)"), respectively.

FIG. 24A: Diagram of experiment. Lenalidomide recruits the E3 ligase Cereblon (CRBN) to the IKZF3 beta hairpin, leading to ubiquitination and degradation of the associated protein. To test that this recruitment occurred in HilD-Tau fusions, HilD-Tau-biotin ligase fusions were generated. In the presence of biotin, biotin ligase generates a reactive biotin species which covalently binds to nearby proteins. If lenalidomide is added, CRBN should be recruited to the HilD-Tau fusion, and should be in range of biotin ligase mediated biotinylation. FIG. 24B: HEK293T cells were transfected with FLAG-tagged CRBN and HilD-Tau-biotin ligase or Tau-biotin ligase fusions. 48 hours after transfection, cells were treated for 21 hours with 50 μM biotin and either DMSO or 1 μM lenalidomide. Cells were subsequently washed in PBS, and then lysed in ice-cold M-PER buffer and protease inhibitors. Approximately 1 million cells were estimated to be lysed, in a volume of 300 μL. Western analysis of cell lysate is shown in lower blot, probed with anti-Tau (HT7) or anti-GAPDH antibodies. Biotinylated proteins were immunoprecipitated by incubating 20% of cell lysate with 50 μL of streptavidin magnetic beads (Dynabeads M-280) for 30 minutes at room temperature. Biotinylated proteins were eluted from beads by boiling, and then analyzed by Western. Probing for FLAG signal on FLAG-CRBN, strong bands were observed only in immunoprecipitated material from HEK293T cells treated with lenalidomide and containing HilD tags, but not in cells treated with DMSO, or in cells treated with lenalidomide but transfected with Tau constructs not containing the HilD tag.

FIGS. 25A, 25B and 25C are graphs showing reduction of toxic Tau protein by inducible recruitment of the E3 ligase CRBN. HEK293T cells were transfected with HilD-Tau (P301S)-YFP fusion constructs. Tau (P301S) is an aggregation-prone form of Tau, identified in patients with familial neurodegenerative diseases. Upon overnight treatment with lenalidomide, YFP fluorescence was reduced in a dose-dependent fashion by lenalidodmide, as seen in imaging of YFP fluorescence (FIG. 25A). Nine fields of view per condition are shown. FIG. 25B: YFP fluorescence intensity was quantified after lenalidomide treatment at various doses. FIG. 25C: Toxicity due to overexpression of the aggregation-prone Tau was noted, quantified by the number of cells, identified by segmentation of Hoecht dye fluorescence. Cell death was abrogated by lenalidomide treatment and reduction of Tau levels, indicating that lenalidomide inducible degradation can reveal cytoprotective action of targeted protein degradation of toxic proteins.

FIG. 26A: HEK293T cells were transfected with HilD-Tau (wild type) fusion constructs and treated with either lenalidomide, at varying doses, or DMSO. Top and bottom Western blots are representative of experiments repeated in triplicate. Intensity of Tau bands, from either a polyclonal anti-Tau antibody (Dako) or an antibody against phosphorylated forms of Tau (AT8) were quantified by normalization to anti-Actin band intensity. Transfection of a reduced amount of DNA in this experiment yielded a greater reduction of the phosphorylated form of Tau (1×DNA: 0.625 micrograms DNA transfected in 50 μL Optimem media with 1.5 μL lipofectamine 2000; 0.1×DNA=0.0625 micrograms; into 24-well plates of HEK cells). This suggests that this system can measure the capacity of the E3 ligase mediated degradation of Tau. In experiments shown, lenalidomide was dosed 4 hours after transfection (for the higher DNA concentration transfection) or 24 hours after transfection (for the lower DNA concentration transfection). FIG. 26B: Left panels, Tau without a HilD tag was not reduced by lenalidomide treatment. Right panels, there was no reduction of Tau levels by lenalidomide treatment in HEK293T cells knocked out for Cereblon (CRBN). FIG. 26C: Quantification of dose response of lenalidomide treatment on YFP intensity in Cereblon (CRBN) knock out (KO) cells versus wild-type (WT) cells (same data for wild-type cells as shown in FIG. 26B). FIG. 26D: Co-treatment with the Neddylation inhibitor MLN4924 (1 µM), including a 1 hour pretreatment with MLN4924, also prevented degradation of Tau. Altogether this data indicates that the E3 ligase function of CRBN is required for lenalidomide induced HilD-Tau fusion degradation.

FIG. 30A is a set of Western blot graphs of CAR19-HilDtag-transduced Jurkat cells treated with a single dose of lenalidomide over time. Samples from post-compound treatment or post-washout period were tested. FIG. 30B is a set of flow cytometry histograms analyzing the same samples used in the Western blot analysis. An anti-CD3zeta antibody was used in the Western blot analysis and CD19-PE conjugate was used in the flow cytometry analysis.

FIGS. 31A, 31B, and 31C are a set of flow cytometry histograms analyzing CAR expression under different conditions. FIG. 31A is a set of flow cytometry histograms showing CAR expression in primary T cells. The effect of lenalidomide on CAR19 expression at 24 hours is shown in FIG. 31B. The effect of lenalidomide on CAR19-HilD expression at 24 or 48 hours is shown in FIG. 31C.

FIG. 32A is a graph showing percent killing against CD19 negative cells. FIGS. 32B and 32C are graphs showing percent killing of CAR19 T cells (FIG. 32B) or CAR19-HilD T cells (FIG. 32C) against CD19 positive cells in the presence or absence of 1 µM lenalidomide.

FIG. 37A is a graph showing CAR expression in CD3+ cells from splenocytes of mice treated with CART-HilD (Group 1). FIGS. 37B, 37C, and 37D are graphs showing CAR expression in CD3+ cells from splenocytes of mice treated with CART-HilD and lenalidomide (Group 2, Group 3, and Group 4, respectively). The peaks in FIGS. 37A-37D represent CD3 expression levels for individual mice. Group 1. CART19.HilD (5×106). Group 2. CART19-HilD (5×106)+Lena qd. Group 3. CART19-HilD (5×106)+Lena bid. Group 4. CART19.HilD (5×106)+Lena+5 Day. FIG. 37E is a graph summarizing the data.

FIG. 38A is western blot of Jurkat NFAT luciferase (JNL) cells expressing CAR19-CARBtag treated with various doses of Compound I-112 or DMSO for 24 hours, showing a dose-responsive degradation of CAR19-CARBtag. FIG. 38B is a set of histograms showing flow cytometry analysis of CAR19 surface expression in JNL CAR19-CARBtag cells compared to untagged CAR19 cells after treatment with 10 µM Compound I-112. FIG. 38C is a graph showing JNL assay results of JNL luciferase cells expressing CAR19-CARBtag treated with a dose-response of Compound I-112 for 15 hours followed by co-treatment with either K562 (CD19−) or Nalm6 (CD19+) cells with a readout of luciferase activity.

FIG. 40A is a set of histograms showing flow cytometry analysis results of JNL cells infected with BCMACAR HilD-tag treated with a dose-response of lenalidomide for 24 hours, showing a lenalidomide dose-dependent degradation of BCMACAR. FIG. 40B is a graph showing JNL assay results of Jurkat NFAT luciferase cells expressing BCMA-HilDtag treated with a dose-response of lenalidomide for 15 hours followed by co-treatment with KMS11 cells with a readout of luciferase activity.

DETAILED DESCRIPTION

Figure 1A:
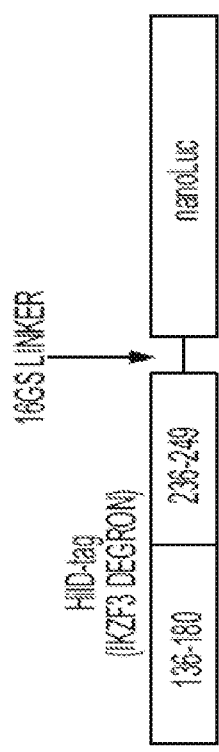
FIG. 1A is a schematic of the HilD-tag IKZF3 136-180 and 236-249 degron fused to Nanoluciferase via a 16 glycine-serine linker.

The present disclosure provides, at least in part, a fusion polypeptide comprising a compound of Formula (I) (COF1)/CRBN-binding polypeptide, a compound of Formula (II) (COF2)/CRBN-binding polypeptide, or a compound of Formula (III) (COF3)/CRBN-binding polypeptide for targeted protein inactivation. In some embodiments, the fusion polypeptide includes one or more COF1/CRBN-, COF2/CRBN-, or COF3/CRBN-binding polypeptides, and one or more heterologous polypeptides, e.g., heterologous mammalian, bacterial, or viral polypeptides, e.g., one or more polypeptides of interest. The COF1/CRBN-, COF2/CRBN-, or COF3/CRBN-binding polypeptide can be operably linked to the heterologous polypeptide, e.g., via a linker. In some embodiments, in the presence of COF1 or COF2 (such as thalidomide and derivatives thereof (e.g., lenalidomide, pomalidomide, and thalidomide)), or in the presence of COF3 (e.g., a compound disclosed in Table 29), the COF1/CRBN-, COF2/CRBN-, or COF3/CRBN-binding polypeptide increases degradation, e.g., ubiquitination-mediated degradation, of the fusion polypeptide; and/or alters the level and/or activity of the fusion polypeptide. In some embodiments, the degradation of the fusion polypeptide is ubiquitin-dependent.

Without wishing to be bound by theory, in some embodiments, the COF1/CRBN-, COF2/CRBN-, or COF3/CRBN-binding polypeptide provides an amino acid sequence and/or a structural motif that, in the presence of COF1 or COF2 (such as thalidomide and derivatives thereof (e.g., lenalidomide, pomalidomide, and thalidomide)), or in the presence of COF3 (e.g., a compound disclosed in Table 29), results in a post-translational modification (e.g., ubiquitination) of the fusion polypeptide, resulting in a modified, e.g., ubiquitinated, fusion polypeptide. For example, one or more amino acids, e.g., lysine or methionine, in the fusion polypeptide can be ubiquitinated, in the presence of COF1, COF2, or COF3. In some embodiments, the ubiquitinated fusion polypeptide is selectively degraded. In some embodiments, the post-translational modification of the fusion polypeptide increases the degradation (e.g., an increased level and/or rate of degradation) of the fusion polypeptide (e.g., all or a part of the heterologous polypeptide). In some embodiments, the increase in the level and/or rate of degradation is at least 5%, 10%, 15%, 20%, 25%, 30%, 35%, 40%, 45%, 50%, 55%, 60%, 65%, 70%, 75%, 80%, 85%, 90%, 95%, 100%, 200%, 500%, 10 times, 100 times, 1,000 times, or higher than the level and/or rate of degradation of a reference protein, e.g., the fusion polypeptide in the absence of COF1, COF2, or COF3, the heterologous polypeptide, a fusion of the heterologous polypeptide without the COF1/CRBN-, COF2/CRBN-, or COF3/CRBN-binding polypeptide, or a fusion of the heterologous polypeptide with a moiety other than the COF1/CRBN-, COF2/CRBN-, or COF3/CRBN-binding polypeptide.

Without wishing to be bound by theory, degradation of the fusion polypeptide can include one, two or all of the following steps: (1) binding of COF1 or COF2 (e.g., thalidomide and derivatives thereof (e.g., lenalidome)), or COF3 (e.g., a compound disclosed in Table 29) to one or more subunits of a ubiquitin ligase complex (e.g., an E3 ubiquitin ligase complex), e.g., binding to CUL4, RBX1, DDBI and/or CRBN, also known as CRL4(CRBN), typically, a DDB1-CRBN complex, thereby forming a COF1-ligase or COF2-ligase complex;

(2) the COF1-ligase, COF2-ligase, or COF3-ligase complex binds to and increases ubiquitination of one or more amino acids, e.g., lysine or methionine, in the fusion polypeptide, thereby forming a ubiquitinated fusion polypeptide, e.g., a mono- or a poly-ubiquitinated fusion polypeptide; and (3) the ubiquitinated fusion polypeptide is targeted for degradation, e.g., the fusion polypeptide is selectively targeted, e.g., to a proteasome, for degradation.

In some embodiments, the COF1/CRBN- or COF2/CRBN-binding polypeptide comprises about 10 to about 95 amino acid residues, about 15 to about 90 amino acid residues, about 20 to about 85 amino acid residues, about 25 to about 80 amino acid residues, about 30 to about 75 amino acid residues, about 35 to about 70 amino acid residues, about 40 to about 65 amino acid residues, about 45 to about 65 amino acid residues, about 50 to about 65 amino acid residues, or about 55 to about 65 amino acid residues of IKZF1 (e.g., SEQ ID NO: 20) or IKZF3 (e.g., SEQ ID NO: 19).

In some embodiments, the COF3/CRBN-binding polypeptide comprises about 10 to about 95 amino acid residues, about 15 to about 90 amino acid residues, about 20 to about 85 amino acid residues, about 25 to about 80 amino acid residues, about 30 to about 75 amino acid residues, about 35 to about 70 amino acid residues, about 40 to about 65 amino acid residues, about 45 to about 65 amino acid residues, about 50 to about 65 amino acid residues, or about 55 to about 65 amino acid residues of IKZF2 (e.g., SEQ ID NO: 21).

In some embodiments, the COF1/CRBN- or COF2/CRBN-binding polypeptide comprises a beta turn (e.g., a beta turn of IKZF3). In some embodiments, the COF1/CRBN- or COF2/CRBN-binding polypeptide comprises a beta turn (e.g., a beta turn of IKZF3) and an alpha helix (e.g., an alpha helix of IKZF3). In some embodiments, the COF1/CRBN- or COF2/CRBN-binding polypeptide comprises amino acid residues 136 to 170 or 136 to 180 and/or 236-249 of IKZF3 (numbered according to SEQ ID NO: 19) or an amino acid sequence substantially identical thereto (e.g., least 85, 87, 90, 95, 97, 98, 99, or 100% identical thereto). In some embodiments, the COF1/CRBN- or COF2/CRBN-binding polypeptide comprises an amino acid sequence selected from the group consisting of SEQ ID NOs: 1-6, 11-15, 40, 41-43, 77, 78, 84-86, and 100 or an amino acid sequence substantially identical thereto (e.g., least 85, 87, 90, 95, 97, 98, 99, or 100% identical thereto).

In some embodiments, the COF3/CRBN-binding polypeptide comprises a beta turn (e.g., a beta turn of IKZF2). In some embodiments, the COF3/CRBN-binding polypeptide comprises a beta turn (e.g., a beta turn of IKZF2) and an alpha helix (e.g., an alpha helix of IKZF2). In some embodiments, the COF3/CRBN-binding polypeptide comprises amino acid residues 130-174 and/or 230-243 of IKZF2 (numbered according to SEQ ID NO: 21) or an amino acid sequence substantially identical thereto (e.g., least 85, 87, 90, 95, 97, 98, 99, or 100% identical thereto). In some embodiments, the COF3/CRBN-binding polypeptide comprises an amino acid sequence selected from the group consisting of SEQ ID NOs: 109, 113, and 114, or an amino acid sequence substantially identical thereto (e.g., least 85, 87, 90, 95, 97, 98, 99, or 100% identical thereto).

In some embodiments, the COF1/CRBN- or COF2/CRBN-binding polypeptide comprises a beta turn (e.g., a beta turn of IKZF1). In some embodiments, the COF1/CRBN- or COF2/CRBN-binding polypeptide comprises a beta turn (e.g., a beta turn of IKZF1) and an alpha helix (e.g., an alpha helix of IKZF1).

In some embodiments, the heterologous polypeptide of the fusion polypeptide is susceptible to a post-translational modification (e.g., ubiquitination at one or more residues) and degradation in the presence of COF1 or COF2 (e.g., thalidomide and derivatives thereof, e.g., lenalidomide, pomalidomide, and thalidomide), or in the presence of COF3 (e.g., a compound disclosed in Table 29).

Optionally, the COF1/CRBN-, COF2/CRBN-, or COF3/CRBN-binding polypeptide and the heterologous polypeptide can be operatively linked, e.g., via a linker, e.g., a glycine-serine linker (e.g., SEQ ID NO: 28, 37, 38, 39, or 99). For example, the fusion polypeptides can include three elements: a COF1/CRBN-, COF2/CRBN-, or COF3/CRBN-binding polypeptide, e.g., a portion of a degradation amino acid sequence (e.g., a degron), a heterologous polypeptide of interest to be degraded, and a linker separating the two. The heterologous polypeptide can be a cytosolic protein, a nuclear protein, a transmembrane protein (e.g., including one or more transmembrane domains), or a secreted protein. For example, heterologous polypeptides of interest can include, e.g., a chimeric antigen receptor (CAR), a CRISPR associated protein, CD8, CD19, CD22, a transcription factor (e.g., STAT3, STAT5, NF-kappaB, beta-catenin, Notch, GLI, or c-JUN), e.g., as described herein.

In some embodiments, the fusion polypeptide of this invention further comprises a degradation domain. In some embodiments, the degradation domain has a first state associated with a first level of expression of the fusion polypeptide and a second state associated with a second level of expression of the fusion polypeptide, wherein the second level is increased, e.g., by at least 2-, 3-, 4-, 5-, 10-, 20- or 30-fold over the first level in the presence of a stabilization compound. In some embodiments, the degradation domain is separated from the COF1/CRBN-binding polypeptide and the heterologous polypeptide by a heterologous cleavage site. In some embodiments, the degradation domain is separated from the COF2/CRBN-binding polypeptide and the heterologous polypeptide by a heterologous cleavage site. In some embodiments, the degradation domain is separated from the COF3/CRBN-binding polypeptide and the heterologous polypeptide by a heterologous cleavage site.

In some embodiments, the fusion polypeptide comprises a first domain and a second domain, wherein the first domain comprises a degradation domain and the second domain comprises a COF1/CRBN-, COF2/CRBN-, or COF3/CRBN-binding polypeptide and a heterologous polypeptide. In some embodiments, the first domain and the second domain are separated by a heterologous cleavage site. Without wishing to be bound by theory, the expression level of the fusion polypeptide can be regulated by a stabilization compound and COF1, COF2, or COF3. In some embodiments, in the absence of the stabilization compound, the degradation domain is unable to acquire a proper conformation and is targeted for degradation by intracellular degradation pathways along with the rest of the fusion polypeptide. In some embodiments, in the presence of the stabilization compound, the degradation domain assumes a proper conformation and is less susceptible to degradation by intracellular degradation pathways. In some embodiments, in the presence of the stabilization compound, the proper folding of the degradation domain exposes the heterologous cleavage site, leaving to the cleavage of the heterologous cleavage site and the removal of the degradation domain from the rest of the fusion polypeptide. The level of the fusion polypeptide can be further regulated by COF1, COF2, or COF3 as described above.

In some embodiments, the degradation domain is chosen from an estrogen receptor (ER) domain, an FKB protein (FKBP) domain, or a dihydrofolate reductase (DHFR) domain. In some embodiments, the degradation domain is an estrogen receptor (ER) domain, e.g., the degradation domain comprises an amino acid sequence that is at least 90, 95, 97, 98, 99, or 100% identical to SEQ ID NO: 46 or 48, e.g., the degradation domain comprises the amino acid sequence of SEQ ID NO: 46. In some embodiments, the degradation domain is an estrogen receptor (ER) domain and the stabilization compound is bazedoxifene or 4-hydroxy tamoxifen (4-OHT). In some embodiments, the degradation domain is an FKB protein (FKBP) domain, e.g., the degradation domain comprises an amino acid sequence that is at least 90, 95, 97, 98, 99, or 100% identical to SEQ ID NO: 50, e.g., the degradation domain comprises the amino acid sequence of SEQ ID NO: 50. In some embodiments, the degradation domain is an FKB protein (FKBP) domain and the stabilization compound is Shield-1. In some embodiments, the degradation domain is a dihydrofolate reductase (DHFR) domain, e.g., the degradation domain comprises an amino acid sequence that is at least 90, 95, 97, 98, 99, or 100% identical to SEQ ID NO: 51, e.g., the degradation domain comprises the amino acid sequence of SEQ ID NO: 51. In some embodiments, the degradation domain is a dihydrofolate reductase (DHFR) domain and the stabilization compound is trimethoprim.

Accordingly, disclosed herein are fusion polypeptides that include a heterologous polypeptide, a COF1/CRBN-, COF2/CRBN-, or COF3/CRBN-binding polypeptide, and/or a degradation domain, e.g., polypeptides of interest for selective protein degradation, as well as nucleic acid molecules encoding the fusion polypeptides, vectors and cells, e.g., host cells, that include the aforesaid fusion polypeptides. The fusion polypeptides and related compositions disclosed herein can be used to activate or inactivate, e.g., degrade, a variety of target proteins for regulating therapies, e.g., secreted, cellular, or transmembrane therapies (e.g., CAR therapies), regulating gene expression (e.g., via regulating the expression and/or activity of a component of the CRISPR/CAS system), validating target, as well as screening libraries. Methods for selectively regulating (e.g., degrading) said fusion polypeptides for, e.g., treating a subject are additionally disclosed.

The compositions and methods disclosed herein offer novel and inventive features over art known regulation systems, including the fact that the COF1/CRBN-, COF2/CRBN-, or COF3/CRBN-binding polypeptide is acting at the protein level (as opposed to mRNA) and leads to active degradation of existing and newly made proteins in a cell (as opposed to blocking the production of a nascent protein). In addition, the COF1/CRBN-, COF2/CRBN-, or COF3/CRBN-binding polypeptide can have a short length and COF1, COF2, and COF3 are typically of low molecular weights.

Without wishing to be bound by theory, as described in Example 16, COF1 or COF2 (e.g., thalidomide and derivatives thereof (e.g., lenalidomide, pomalidomide, and thalidomide)) does not lead to, or does not substantially lead to degradation of a fusion polypeptide comprising a COF3/CRBN-binding polypeptide described herein (e.g., a fusion polypeptide comprising a CARB tag described herein, e.g., a fusion polypeptide comprising a CARB tag comprising an amino acid sequence selected from the group consisting of SEQ ID NOs: 109, 113, and 114). In some embodiments, the degradation of a fusion polypeptide comprising a COF3/CRBN-binding polypeptide described herein in the presence of COF1 or COF2 is no more than 1, 2, 3, 4, 5, 6, 7, 8, 9, 10, 15, or 20% of the degradation of said fusion polypeptide in the presence of COF3 under same conditions.

Similarly, COF3 (e.g., a compound disclosed in Table 29) does not lead to, or does not substantially lead to degradation of a fusion polypeptide comprising a COF1/CRBN- or COF2/CRBN-binding polypeptide described herein (e.g., a fusion polypeptide comprising a HilD tag described herein, e.g., a fusion polypeptide comprising a HilD tag comprising an amino acid sequence selected from the group consisting of SEQ ID NOs: 1-6, 11-15, 40, 41-43, 77, 78, 84-86, and 100). In some embodiments, the degradation of a fusion polypeptide comprising a COF1/CRBN- or COF2/CRBN-binding polypeptide described herein in the presence of COF3 is no more than 1, 2, 3, 4, 5, 6, 7, 8, 9, 10, 15, or 20% of the degradation of said fusion polypeptide in the presence of COF1 or COF2 under same conditions.

As a consequence, two target polypeptides, one tagged with a COF1/CRBN- or COF2/CRBN-binding polypeptide (e.g., a HilD tag descried herein), the other tagged with a COF3/CRBN-binding polypeptide (e.g., a CARB tag described herein), can be regulated independently using COF1 or COF2 and COF3. For example, a cell expressing a HilD-tagged protein and a CARB-tagged protein can be manipulated to express only the HilD-tagged protein (e.g., by contacting the cell with COF3), express only the CARB-tagged protein (e.g., by contacting the cell with COF1 or COF2), or express neither protein (e.g., by contacting the cell with COF1 or COF2 and COF3).

Definitions

Unless defined otherwise, all technical and scientific terms used herein have the same meaning as commonly understood by one of ordinary skill in the art to which the invention pertains.

As used herein, the term "compound of Formula (I) (COF1)/CRBN-binding polypeptide" refers to a polypeptide that binds to COF1, a polypeptide that binds to a complex of COF1 and CRBN, or a polypeptide that binds to CRBN in the presence of COF1. In some embodiments, the COF1/CRBN-binding polypeptide binds to COF1 with an affinity ($K_D$) that is lower than $10^{-3}$, $10^{-4}$, $10^{-5}$, $10^{-6}$, $10^{-7}$, or $10^{-8}$ M, e.g., as measured by a method recognized in the art, e.g., Biacore. In some embodiments, the COF1/CRBN-binding polypeptide binds to the complex of COF1 and CRBN with an affinity ($K_D$) that is lower than $10^{-3}$, $10^{-4}$, $10^{-5}$, $10^{-6}$, $10^{-7}$, or $10^{-8}$M, e.g., as measured by a method recognized in the art, e.g., Biacore. In some embodiments, the COF1/CRBN-binding polypeptide binds to CRBN in the presence of COF1 with an affinity ($K_D$) that is lower than $10^{-3}$, $10^{-4}$, $10^{-5}$, $10^{-6}$, $10^{-7}$, or $10^{-8}$M, e.g., as measured by a method recognized in the art, e.g., Biacore. In some embodiments, the COF1/CRBN-binding polypeptide, when present in a fusion polypeptide (e.g., operably linked to a heterologous polypeptide (e.g., a fusion polypeptide as described herein)), can result in an increase in ubiquitination of the fusion polypeptide. In some embodiments, the COF1/CRBN-binding polypeptide, when present in a fusion polypeptide (e.g., operably linked to a heterologous polypeptide (e.g., a fusion polypeptide as described herein)), can result in an increase in degradation of the fusion polypeptide. In some embodiments, the COF1/CRBN-binding polypeptide, when present in a fusion polypeptide (e.g., operably linked to a heterologous polypeptide (e.g., a fusion polypeptide as described herein)), can result in an increase in inactivation of the fusion polypeptide. In some embodiments, the increase in ubiquitination, degradation, and/or inactivation occurs in the presence of COF1 and one or more components of a ubiquitination ligase complex (e.g., CRBN). In some embodiments, the increase in ubiquitination, degradation, and/or inactivation is at least 5%, 10%, 15%, 20%, 25%, 30%, 35%, 40%, 45%, 50%, 55%, 60%, 65%, 70%, 75%, 80%, 85%, 90%, 95%, 100%, 200%, 500%, 10 times, 100 times, 1,000 times, or higher than ubiquitination, degradation, and/or inactivation of a reference polypeptide, e.g., a reference fusion polypeptide with the COF1/CRBN-binding polypeptide in the absence of COF1, or a reference polypeptide without the COF1/CRBN-binding polypeptide. In some embodiments, the degradation of the fusion polypeptide containing the COF1/CRBN-binding polypeptide is ubiquitin-dependent. For example, one or more amino acids, e.g., lysine or methionine, in the fusion polypeptide with the COF1/CRBN-binding polypeptide are ubiquitinated, in the presence of COF1.

As used herein, the term "compound of Formula (II) (COF2)/CRBN-binding polypeptide" refers to a polypeptide that binds to COF2, a polypeptide that binds to a complex of COF2 and CRBN, or a polypeptide that binds to CRBN in the presence of COF2. In some embodiments, the COF2/CRBN-binding polypeptide binds to COF2 with an affinity ($K_D$) that is lower than $10^{-3}$, $10^{-4}$, $10^{-5}$, $10^{-6}$, $10^{-7}$, or $10^{-8}$ M, e.g., as measured by a method recognized in the art, e.g., Biacore. In some embodiments, the COF2/CRBN-binding polypeptide binds to the complex of COF2 and CRBN with an affinity ($K_D$) that is lower than $10^{-3}$, $10^{-4}$, $10^{-5}$, $10^{-6}$, $10^{-7}$, or $10^{-8}$M, e.g., as measured by a method recognized in the art, e.g., Biacore. In some embodiments, the COF2/CRBN-binding polypeptide binds to CRBN in the presence of COF2 with an affinity ($K_D$) that is lower than $10^{-3}$, $10^{-4}$, $10^{-5}$, $10^{-6}$, $10^{-7}$, or $10^{-8}$M, e.g., as measured by a method recognized in the art, e.g., Biacore. In some embodiments, the COF2/CRBN-binding polypeptide, when present in a fusion polypeptide (e.g., operably linked to a heterologous polypeptide (e.g., a fusion polypeptide as described herein)), can result in an increase in ubiquitination of the fusion polypeptide. In some embodiments, the COF2/CRBN-binding polypeptide, when present in a fusion polypeptide (e.g., operably linked to a heterologous polypeptide (e.g., a fusion polypeptide as described herein)), can result in an increase in degradation of the fusion polypeptide. In some embodiments, the COF2/CRBN-binding polypeptide, when present in a fusion polypeptide (e.g., operably linked to a heterologous polypeptide (e.g., a fusion polypeptide as described herein)), can result in an increase in inactivation of the fusion polypeptide. In some embodiments, the increase in ubiquitination, degradation, and/or inactivation occurs in the presence of COF2 and one or more components of a ubiquitination ligase complex (e.g., CRBN). In some embodiments, the increase in ubiquitination, degradation, and/or inactivation is at least 5%, 10%, 15%, 20%, 25%, 30%, 35%, 40%, 45%, 50%, 55%, 60%, 65%, 70%, 75%, 80%, 85%, 90%, 95%, 100%, 200%, 500%, 10 times, 100 times, 1,000 times, or higher than ubiquitination, degradation, and/or inactivation of a reference polypeptide, e.g., a reference fusion polypeptide with the COF2/CRBN-binding polypeptide in the absence of COF2, or a reference polypeptide without the COF2/CRBN-binding polypeptide. In some embodiments, the degradation of the fusion polypeptide containing the COF2/CRBN-binding polypeptide is ubiquitin-dependent. For example, one or more amino acids, e.g., lysine or methionine, in the fusion polypeptide with the COF2/CRBN-binding polypeptide are ubiquitinated, in the presence of COF2.

As used herein, the term "compound of Formula (III) (COF3)/CRBN-binding polypeptide" refers to a polypeptide that binds to COF3, a polypeptide that binds to a complex of COF3 and CRBN, or a polypeptide that binds to CRBN in the presence of COF3. In some embodiments, the COF3/CRBN-binding polypeptide binds to COF3 with an affinity ($K_D$) that is lower than $10^{-3}$, $10^{-4}$, $10^{-5}$, $10^{-6}$, $10^{-7}$, or $10^{-8}$ M, e.g., as measured by a method recognized in the art, e.g., Biacore. In some embodiments, the COF3/CRBN-binding polypeptide binds to the complex of COF3 and CRBN with an affinity ($K_D$) that is lower than $10^{-3}$, $10^{-4}$, $10^{-5}$, $10^{-6}$, $10^{-7}$, or $10^{-7}$ M, e.g., as measured by a method recognized in the art, e.g., Biacore. In some embodiments, the COF3/CRBN-binding polypeptide binds to CRBN in the presence of COF3 with an affinity ($K_D$) that is lower than $10^{-3}$, $10^{-4}$, $10^{-5}$, $10^{-6}$, $10^{-7}$, or $10^{-8}$ M, e.g., as measured by a method recognized in the art, e.g., Biacore. In some embodiments, the COF3/CRBN-binding polypeptide, when present in a fusion polypeptide (e.g., operably linked to a heterologous polypeptide (e.g., a fusion polypeptide as described herein)), can result in an increase in ubiquitination of the fusion polypeptide. In some embodiments, the COF3/CRBN-binding polypeptide, when present in a fusion polypeptide (e.g., operably linked to a heterologous polypeptide (e.g., a fusion polypeptide as described herein)), can result in an increase in degradation of the fusion polypeptide. In some embodiments, the COF3/CRBN-binding polypeptide, when present in a fusion polypeptide (e.g., operably linked to a heterologous polypeptide (e.g., a fusion polypeptide as described herein)), can result in an increase in inactivation of the fusion polypeptide. In some embodiments, the increase in ubiquitination, degradation, and/or inactivation occurs in the presence of COF3 and one or more components of a ubiquitination ligase complex (e.g., CRBN). In some embodiments, the increase in ubiquitination, degradation, and/or inactivation is at least 5%, 10%, 15%, 20%, 25%, 30%, 35%, 40%, 45%, 50%, 55%, 60%, 65%, 70%, 75%, 80%, 85%, 90%, 95%, 100%, 200%, 500%, 10 times, 100 times, 1,000 times, or higher than ubiquitination, degradation, and/or inactivation of a reference polypeptide, e.g., a reference fusion polypeptide with the COF3/CRBN-binding polypeptide in the absence of COF3, or a reference polypeptide without the COF3/CRBN-binding polypeptide. In some embodiments, the degradation of the fusion polypeptide containing the COF3/CRBN-binding polypeptide is ubiquitin-dependent. For example, one or more amino acids, e.g., lysine or methionine, in the fusion polypeptide with the COF3/CRBN-binding polypeptide are ubiquitinated, in the presence of COF3.

As used herein, "ubiquitination" refers to the addition of a ubiquitin molecule, e.g., a single ubiquitin (mono-ubiquitination) or more than one ubiquitin (e.g., a chain of ubiquitin molecules, or poly-ubiquitination). Ubiquitination can be performed by an enzyme machinery including one or more of a ubiquitin-activating enzyme (E1), a ubiquitin-conjugating enzyme (E2), and a ubiquitin ligase (E3).

As used herein, the term "CRBN" refers to a protein that in humans is encoded by the CRBN gene, or fragment or variant thereof (e.g., an amino acid sequence substantially identical thereto, e.g., least 85, 87, 90, 95, 97, 98, 99, or 100% identical thereto). Swiss-Prot accession number Q96SW2 provides exemplary human CRBN amino acid sequences.

As used herein, an "IKZF polypeptide" refers to an IKZF, or fragment or variant thereof (e.g., an amino acid sequence substantially identical thereto, e.g., least 85, 87, 90, 95, 97, 98, 99, or 100% identical thereto).

As used herein, the term "IKZF3" refers to a protein that in humans is encoded by the IKZF3 gene. Swiss-Prot accession number Q9UKT9 provides exemplary human IKZF3 amino acid sequences. An exemplary human IKZF3 amino acid sequence is provided in SEQ ID NO: 19. The term "IKZF3 polypeptide" refers to IKZF3, or fragment or variant thereof (e.g., an amino acid sequence substantially identical thereto, e.g., least 85, 87, 90, 95, 97, 98, 99, or 100% identical thereto).

As used herein, the term "IKZF1" refers to a protein that in humans is encoded by the IKZF1 gene. Swiss-Prot accession number Q13422 provides exemplary human IKZF1 amino acid sequences. An exemplary human IKZF1 amino acid sequence is provided in SEQ ID NO: 20. The term "IKZF1 polypeptide" refers to IKZF1, or fragment or variant thereof (e.g., an amino acid sequence substantially identical thereto, e.g., least 85, 87, 90, 95, 97, 98, 99, or 100% identical thereto).

As used herein, the term "IKZF2" refers to a protein that in humans is encoded by the IKZF2 gene. Swiss-Prot accession number Q9UKS7 provides exemplary human IKZF2 amino acid sequences. An exemplary human IKZF2 amino acid sequence is provided in SEQ ID NO: 21. The term "IKZF2 polypeptide" refers to IKZF2, or fragment or variant thereof (e.g., an amino acid sequence substantially identical thereto, e.g., least 85, 87, 90, 95, 97, 98, 99, or 100% identical thereto).

As used herein, the term "IKZF4" refers to a protein that in humans is encoded by the IKZF4 gene. Swiss-Prot accession number Q9H2S9 provides exemplary human IKZF4 amino acid sequences. An exemplary human IKZF4 amino acid sequence is provided in SEQ ID NO: 22. The term "IKZF4 polypeptide" refers to IKZF4, or fragment or variant thereof (e.g., an amino acid sequence substantially identical thereto, e.g., least 85, 87, 90, 95, 97, 98, 99, or 100% identical thereto).

As used herein, the term "IKZF5" refers to a protein that in humans is encoded by the IKZF5 gene. Swiss-Prot accession number Q9H5V7 provides exemplary human IKZF5 amino acid sequences. An exemplary human IKZF5 amino acid sequence is provided in SEQ ID NO: 23. The term "IKZF5 polypeptide" refers to IKZF5, or fragment or variant thereof (e.g., an amino acid sequence substantially identical thereto, e.g., least 85, 87, 90, 95, 97, 98, 99, or 100% identical thereto).

As used herein, a "fusion polypeptide" or "chimeric polypeptide" refers to a polypeptide that includes two or more heterologous amino acid sequences and/or protein domains in a single, continuous polypeptide. In some embodiments, the two or more heterologous protein domains are covalently linked directly or indirectly, e.g., via a linker.

As used herein, the term "estrogen receptor (ER)" refers to a protein that in humans is encoded by the ESR1 gene. Swiss-Prot accession number P03372 provides exemplary human estrogen receptor (ER) amino acid sequences. An "estrogen receptor (ER) domain" refers to estrogen receptor, or fragment or variant thereof (e.g., an amino acid sequence substantially identical thereto, e.g., least 85, 87, 90, 95, 97, 98, 99, or 100% identical thereto). Exemplary estrogen receptor (ER) domain amino acid sequences are provided in SEQ ID NOs: 44, 46, and 48. Exemplary estrogen receptor (ER) domain nucleotide sequences are provided in SEQ ID NOs: 45, 47, and 49.

As used herein, an "FKB protein (FKBP) domain" refers to FKBP, or fragment or variant thereof. An exemplary FKB protein (FKBP) domain amino acid sequence is provided in SEQ ID NO: 50.

As used herein, the term "dihydrofolate reductase (DHFR)" refers to a protein that in humans is encoded by the DHFR gene. Swiss-Prot accession number P00374 provides exemplary human dihydrofolate reductase (DHFR) amino acid sequences. A "dihydrofolate reductase (DHFR) domain" refers to DHFR, or fragment or variant thereof. An exemplary dihydrofolate reductase (DHFR) domain amino acid sequence is provided in SEQ ID NO: 51.

As used herein, the term "degradation domain" refers to a domain of a fusion polypeptide that assumes a stable conformation when expressed in the presence of a stabilization compound. Absent the stable conformation when expressed in a cell of interest, a large fraction of degradation domains (and, typically, any protein to which they are fused to) will be degraded by endogenous cellular machinery. Notably, a degradation domain is not a naturally occurring domain of a protein but is rather engineered to be unstable absent contact with the stabilization compound. Thus, a degradation domain is identifiable by the following characteristics: (1) it is not naturally occurring; (2) its expression is regulated co-translationally or post-translationally through increased or decreased degradation rates; (3) the rate of degradation is substantially decreased in the presence of a stabilization compound. In some embodiments, absent a stabilization compound, the degradation domain or other domain of the fusion polypeptide is not substantially detectable in or on the cell. In some embodiments, the degradation domain is in a destabilized state in the absence of a stabilization compound. In some embodiments, the degradation domain does not self-associate, e.g., does not homodimerize, in the absence of a stabilization compound. In some embodiments, the degradation domain is fused to a heterologous protease cleavage site, wherein in the presence of the stabilization compound, the cleavage of the heterologous protease cleavage site is more efficient than in the absence of the stabilization compound.

The degradation domain is not an aggregation domain as defined in PCT Application Number PCT/US2017/027778.

By "stabilization compound" or "stabilizing compound" is meant a compound that, when added to a cell expressing a degradation domain, stabilizes the degradation domain and any protein that is fused to it, and decreases the rate at which it is subsequently degraded. Stabilization compounds or stabilizing compounds can be naturally occurring or synthetic.

By the term "heterologous polypeptide" is meant an amino acid sequence (e.g., a protein domain) that is different from a COF1/CRBN-, COF2/CRBN-, or COF3/CRBN-binding polypeptide (e.g., by at least one amino acid) and that is not an active luciferase domain or has a luciferase sequence. In some embodiments, the heterologous polypeptide is not a reporter polypeptide, e.g., a luciferase, a green fluorescent protein, or a b-galactosidase. In some embodiments, the heterologous polypeptide comprises an amino acid sequence from, or derived from, a mammalian polypeptide, a bacterial polypeptide, a viral polypeptide, a plant polypeptide, a yeast polypeptide, a fungi polypeptide, an archaebacterial polypeptide, or a fish, e.g., Zebrafish, polypeptide. In some embodiments, the heterologous polypeptide comprises a polypeptide in Table 2, e.g., a cytoplasmic and/or nuclear polypeptide, a secretory polypeptide, or a transmembrane polypeptide as described in Table 2.

Furthermore, by "heterologous protease cleavage site" is meant a protease cleavage site that has a different origin than one or more protein domains to which it is fused (e.g., is not naturally fused to at least one of the other referenced domains)

By "protease" is meant a protein that cleaves another protein based on the presence of a cleavage site in the to-be-cleaved protein.

By "intracellular protease" is meant a protease that is natively expressed inside a cell of interest.

By "extracellular protease" is meant a protease that is natively expressed in an organism (e.g., a mammal) and secreted or exposed to the outside of cells (e.g., in the blood or the surface of the skin).

As used herein, the term "cleavage" refers to the breakage of covalent bonds, such as in the backbone of a nucleic acid molecule or the hydrolysis of peptide bonds. Cleavage can be initiated by a variety of methods, including, but not limited to, enzymatic or chemical hydrolysis of a phosphodiester bond. Both single-stranded cleavage and double-stranded cleavage are possible. Double-stranded cleavage can occur as a result of two distinct single-stranded cleavage events.

Additional terms are described herein below.

The term "a" and "an" refers to one or to more than one (i.e., to at least one) of the grammatical object of the article. By way of example, "an element" means one element or more than one element.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods.

The term "antibody," as used herein, refers to a protein, or polypeptide sequence derived from an immunoglobulin molecule which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab')$_2$, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3)(see U.S. Pat. No. 6,703,199, which describes fibronectin polypeptide minibodies).

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "antigen," "Ag," or "antigen molecule" refers to a molecule that provokes an immune response. This immune response may involve either antibody production, or the activation of specific immunologically-competent cells, or both. In some embodiments, an antigen is any macromolecule, including all proteins or peptides. In other embodiments, antigens are derived from recombinant or genomic DNA. Any DNA, which comprises nucleotide sequences or a partial nucleotide sequence encoding a protein that elicits an immune response therefore encodes an "antigen" as that term is used herein.

An antigen need not be encoded solely by a full length nucleotide sequence of a gene. In embodiments, antigens include, but are not limited to, the use of partial nucleotide sequences of more than one gene and that these nucleotide sequences are arranged in various combinations to encode polypeptides that elicit the desired immune response. In an embodiment, an antigen need not be encoded by a "gene" at all. In one embodiment, an antigen can be generated synthesized or can be derived from a biological sample, or might be macromolecule besides a polypeptide. Such a biological sample can include, but is not limited to a tissue sample, a tumor sample, a cell or a fluid with other biological components. In embodiments, antigens include, for example, carbohydrates (e.g., monosaccharides, disaccharides, oligosaccharides, and polysaccharides).

The term "antigen presenting cell" or "APC" refers to an immune system cell such as an accessory cell (e.g., a B-cell, a dendritic cell, and the like) that displays a foreign antigen complexed with major histocompatibility complexes (MHC's) on its surface. T-cells may recognize these complexes using their T-cell receptors (TCRs). APCs process antigens and present them to T-cells.

The term "Chimeric Antigen Receptor" or alternatively a "CAR" refers to a set of polypeptides, typically two in the simplest embodiments, which when in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule as defined below. In some embodiments, the set of polypeptides are in the same polypeptide chain (e.g., comprise a chimeric fusion protein). In some embodiments, the set of polypeptides are not contiguous with each other, e.g., are in different polypeptide chains. In some embodiments, the set of polypeptides are not contiguous with each other, e.g., are in different polypeptide chains. In some embodiments, the set of polypeptides include a dimerization switch that, upon the presence of a dimerization molecule, can couple the fusion polypeptides to one another, e.g., can couple an antigen binding domain to an intracellular signaling domain. In one aspect, the stimulatory molecule is the zeta chain associated with the T cell receptor complex. In one aspect, the cytoplasmic signaling domain comprises a primary signaling domain (e.g., a primary signaling domain of CD3-zeta). In one aspect, the cytoplasmic signaling domain further comprises one or more functional signaling domains derived from at least one costimulatory molecule as defined below. In one aspect, the costimulatory molecule of the CAR is chosen from the costimulatory molecules described herein, e.g., 4-1BB (i.e., CD137), CD27, ICOS, and/or CD28. In one aspect, the CAR comprises a chimeric fusion protein comprising an extracellular antigen binding domain, a transmembrane domain and an intracellular signaling domain comprising a functional signaling domain derived from a stimulatory molecule. In one aspect, the CAR comprises a chimeric fusion protein comprising an extracellular antigen binding domain, a transmembrane domain and an intracellular signaling domain comprising a functional signaling domain derived from a costimulatory molecule and a functional signaling domain derived from a stimulatory molecule. In one aspect, the CAR comprises a chimeric fusion protein comprising an extracellular antigen binding domain, a transmembrane domain and an intracellular signaling domain comprising two functional signaling domains derived from one or more costimulatory molecule(s) and a functional signaling domain derived from a stimulatory molecule. In one aspect, the CAR comprises a chimeric fusion protein comprising an extracellular antigen binding domain, a transmembrane domain and an intracellular signaling domain comprising at least two functional signaling domains derived from one or more costimulatory molecule(s) and a functional signaling domain derived from a stimulatory molecule. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane.

The term "cancer" refers to a disease characterized by the uncontrolled growth of aberrant cells. Cancer cells can spread locally or through the bloodstream and lymphatic system to other parts of the body. Examples of various cancers are described herein and include but are not limited to, breast cancer, prostate cancer, ovarian cancer, cervical cancer, skin cancer, pancreatic cancer, colorectal cancer, renal cancer, liver cancer, brain cancer, lymphoma, leukemia, lung cancer and the like. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"CAR molecule", depending on the context, refers to a CAR (e.g., a CAR polypeptide), a nucleic acid encoding a CAR, or both.

A CAR that comprises an antigen binding domain (e.g., a scFv, or TCR) that targets a specific tumor antigen X, such as those described herein, is also referred to as XCAR. For example, a CAR that comprises an antigen binding domain that targets CD19 or BCMA is referred to as CD19CAR or BCMACAR, respectively.

As used herein, the term "BCMA" refers to B-cell maturation antigen. BCMA (also known as TNFRSF17, BCM or CD269) is a member of the tumor necrosis receptor (TNFR) family and is predominantly expressed on terminally differentiated B cells, e.g., memory B cells, and plasma cells. Its ligand is called B-cell activator of the TNF family (BAFF) and a proliferation inducing ligand (APRIL). BCMA is involved in mediating the survival of plasma cells for mataining long-term humoral immunity. The gene for BCMA is encoded on chromosome 16 producing a primary mRNA transcript of 994 nucleotides in length (NCBI accession NM_001192.2) that encodes a protein of 184 amino acids (NP_001183.2). A second antisense transcript derived from the BCMA locus has been described, which may play a role in regulating BCMA expression. (Laabi Y. et al., Nucleic Acids Res., 1994, 22:1147-1154). Additional transcript variants have been described with unknown significance (Smirnova A S et al. Mol Immunol., 2008, 45(4): 1179-1183. A second isoform, also known as TV4, has been identified (Uniprot identifier Q02223-2). As used herein, "BCMA" includes proteins comprising mutations, e.g., point mutations, fragments, insertions, deletions and splice variants of full length wild-type BCMA.

As used herein, the term "CD19" refers to the Cluster of Differentiation 19 protein, which is an antigenic determinant detectable on leukemia precursor cells. The human and murine amino acid and nucleic acid sequences can be found in a public database, such as GenBank, UniProt and Swiss-Prot. For example, the amino acid sequence of human CD19 can be found as UniProt/Swiss-Prot Accession No. P15391 and the nucleotide sequence encoding of the human CD19 can be found at Accession No. NM_001178098. As used herein, "CD19" includes proteins comprising mutations, e.g., point mutations, fragments, insertions, deletions and splice variants of full length wild-type CD19.

CD19 is expressed on most B lineage cancers, including, e.g., acute lymphoblastic leukaemia, chronic lymphocyte leukaemia and non-Hodgkin lymphoma. Other cells with express CD19 are provided below in the definition of "disease associated with expression of CD19." It is also an early marker of B cell progenitors. See, e.g., Nicholson et al. Mol. Immun 34 (16-17): 1157-1165 (1997). In one aspect the antigen-binding portion of the CART recognizes and binds an antigen within the extracellular domain of the CD19 protein. In one aspect, the CD19 protein is expressed on a cancer cell.

As used herein, the term "CD20" refers to an antigenic determinant known to be detectable on B cells. Human CD20 is also called membrane-spanning 4-domains, subfamily A, member 1 (MS4A1). The human and murine amino acid and nucleic acid sequences can be found in a public database, such as GenBank, UniProt and Swiss-Prot. For example, the amino acid sequence of human CD20 can be found at Accession Nos. NP_690605.1 and NP_068769.2, and the nucleotide sequence encoding transcript variants 1 and 3 of the human CD20 can be found at Accession No. NM_152866.2 and NM_021950.3, respectively. In one aspect the antigen-binding portion of the CAR recognizes and binds an antigen within the extracellular domain of the CD20 protein. In one aspect, the CD20 protein is expressed on a cancer cell. As used herein, "CD20" includes proteins comprising mutations, e.g., point mutations, fragments, insertions, deletions and splice variants of full length wild-type CD20.

As used herein, the terms "CD22," refers to an antigenic determinant known to be detectable on leukemia precursor cells. The human and murine amino acid and nucleic acid sequences can be found in a public database, such as GenBank, UniProt and Swiss-Prot. For example, the amino acid sequences of isoforms 1-5 human CD22 can be found at Accession Nos. NP 001762.2, NP 001172028.1, NP 001172029.1, NP 001172030.1, and NP 001265346.1, respectively, and the nucleotide sequence encoding variants 1-5 of the human CD22 can be found at Accession No. NM 001771.3, NM 001185099.1, NM 001185100.1, NM 001185101.1, and NM 001278417.1, respectively. In one aspect the antigen-binding portion of the CAR recognizes and binds an antigen within the extracellular domain of the CD22 protein. In one aspect, the CD22 protein is expressed on a cancer cell. As used herein, "CD22" includes proteins comprising mutations, e.g., point mutations, fragments, insertions, deletions and splice variants of full length wild-type CD22.

As used herein, the term "CD123" refers to an antigenic determinant known to be detectable on some malignant hematological cancer cells, e.g., leukemia cells. The human and murine amino acid and nucleic acid sequences can be found in a public database, such as GenBank, UniProt and Swiss-Prot. For example, the amino acid sequences of human CD123 can be found at Accession Nos. NP_002174.1 (isoform 1 precursor); NP_001254642.1 (isoform 2 precursor), and the mRNA sequences encoding them can be found at Accession Nos. NM_002183.3 (variant 1); NM_001267713.1 (variant 2). In one aspect the antigen-binding portion of the CAR recognizes and binds an antigen within the extracellular domain of the CD123 protein. In one aspect, the CD123 protein is expressed on a cancer cell. As used herein, "CD123" includes proteins comprising mutations, e.g., point mutations, fragments, insertions, deletions and splice variants of full length wild-type CD123.

The portion of the CAR comprising an antibody or antibody fragment thereof may exist in a variety of forms where the antigen binding domain is expressed as part of a contiguous polypeptide chain including, for example, a single domain antibody fragment (sdAb), a single chain antibody (scFv), a humanized antibody, or bispecific antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one aspect, the antigen binding domain of a CAR composition of the invention comprises an antibody fragment. In a further aspect, the CAR comprises an antibody fragment that comprises a scFv.

The term "cognate antigen molecule" refers to any antigen described herein. In one embodiment, it refers to an antigen recognized, e.g., targeted, by a CAR molecule, e.g., any CAR described herein. In another embodiment, it refers to a cancer associated antigen described herein. In one embodiment, the cognate antigen molecule is a recombinant molecule.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine). Thus, one or more amino acid residues within a polypeptide of interest (e.g., a CAR) described herein can be replaced with other amino acid residues from the same side chain family and the altered polypeptide of interest (e.g., a CAR) can be tested using the functional assays described herein.

The term "costimulatory molecule" refers to the cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that are required for an efficient immune response. Costimulatory molecules include, but are not limited to MHC class I molecule, TNF receptor proteins, Immunoglobulin-like proteins, cytokine receptors, integrins, signalling lymphocytic activation molecules (SLAM proteins), activating NK cell receptors, BTLA, a Toll ligand receptor, OX40, CD2, CD7, CD27, CD28, CD30, CD40, CDS, ICAM-1, LFA-1 (CD11a/CD18), 4-1BB (CD137), B7-H3, CDS, ICAM-1, ICOS (CD278), GITR, BAFFR, LIGHT, HVEM (LIGHTR), KIRDS2, SLAMF7, NKp80 (KLRF1), NKp44, NKp30, NKp46, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, CD19a, and a ligand that specifically binds with CD83.A costimulatory intracellular signaling domain refers to an intracellular portion of a costimulatory molecule. The intracellular signaling domain can comprise the entire intracellular portion, or the entire native intracellular signaling domain, of the molecule from which it is derived, or a functional fragment thereof. The intracellular signaling domain can comprise the entire intracellular portion, or the entire native intracellular signaling domain, of the molecule from which it is derived, or a functional fragment thereof.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an intracellular signaling domain that is derived from a CD3zeta molecule, the intracellular signaling domain retains sufficient CD3zeta structure such that is has the required function, namely, the ability to generate a signal under the appropriate conditions. It does not connotate or include a limitation to a particular process of producing the intracellular signaling domain, e.g., it does not mean that, to provide the intracellular signaling domain, one must start with a CD3zeta sequence and delete unwanted sequence, or impose mutations, to arrive at the intracellular signaling domain.

The phrase "disease associated with expression of a tumor antigen" as described herein includes, but is not limited to, a disease associated with expression of a tumor antigen as described herein or condition associated with cells which express a tumor antigen as described herein including, e.g., proliferative diseases such as a cancer or malignancy or a precancerous condition such as a myelodysplasia, a myelodysplastic syndrome or a preleukemia; or a noncancer related indication associated with cells which express a tumor antigen as described herein. In one embodiment, a cancer associated with expression of a tumor antigen as described herein is a hematological cancer. In one embodiment, a cancer associated with expression of a tumor antigen as described herein is a solid cancer. Further diseases associated with expression of a tumor antigen as described herein include, but are not limited to, e.g., atypical and/or non-classical cancers, malignancies, precancerous conditions or proliferative diseases associated with expression of a tumor antigen as described herein. Non-cancer related indications associated with expression of a tumor antigen as described herein include, but are not limited to, e.g., autoimmune disease, (e.g., lupus), inflammatory disorders (allergy and asthma) and transplantation. In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein.

The phrase "disease associated with expression of CD19" includes, but is not limited to, a disease associated with a cells that expresses CD19 (e.g., wild-type or mutant CD19) or condition associated with a cell which expresses, or at any time expressed, CD19 (e.g., wild-type or mutant CD19) including, e.g., proliferative diseases such as a cancer or malignancy or a precancerous condition such as a myelodysplasia, a myelodysplastic syndrome or a preleukemia; or a noncancer related indication associated with cells which express CD19. For the avoidance of doubt, a disease associated with expression of CD19 may include a condition associated with a cell which does not presently express CD19, e.g., because CD19 expression has been downregulated, e.g., due to treatment with a molecule targeting CD19, e.g., a CD19 CAR, but which at one time expressed CD19. In one aspect, a cancer associated with expression of CD19 is a hematological cancer. In one aspect, the hematolical cancer is a leukemia or a lymphoma. In one aspect, a cancer associated with expression of CD19 includes cancers and malignancies including, but not limited to, e.g., one or more acute leukemias including but not limited to, e.g., acute myeloid leukemia (AML), B-cell acute Lymphoid Leukemia (BALL), T-cell acute Lymphoid Leukemia (TALL), acute lymphoid leukemia (ALL); one or more chronic leukemias including but not limited to, e.g., chronic myelogenous leukemia (CML), Chronic Lymphoid Leukemia (CLL). Additional cancers or hematologic conditions associated with expression of CD19 comprise, but are not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma (MCL), Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, myeloproliferative neoplasm; a histiocytic disorder (e.g., a mast cell disorder or a blastic plasmacytoid dendritic cell neoplasm); a mast cell disorder, e.g., systemic mastocytosis or mast cell leukemia; B-cell prolymphocytic leukemia, plasma cell myeloma, and "preleukemia" which are a diverse collection of hematological conditions united by ineffective production (or dysplasia) of myeloid blood cells, and the like.

Further diseases associated with expression of CD19 expression include, but not limited to, e.g., atypical and/or non-classical cancers, malignancies, precancerous conditions or proliferative diseases associated with expression of CD19. Non-cancer related indications associated with expression of CD19 include, but are not limited to, e.g., autoimmune disease, (e.g., lupus), inflammatory disorders (allergy and asthma) and transplantation. In some embodiments, the CD19-expressing cells express, or at any time expressed, CD19 mRNA. In an embodiment, the CD19-expressing cells produce a CD19 protein (e.g., wild-type or mutant), and the CD19 protein may be present at normal levels or reduced levels. In an embodiment, the CD19-expressing cells produced detectable levels of a CD19 protein at one point, and subsequently produced substantially no detectable CD19 protein.

In some embodiments, the tumor antigen-expressing cells express, or at any time expressed, mRNA encoding the tumor antigen. In an embodiment, the tumor antigen-expressing cells produce the tumor antigen protein (e.g., wild-type or mutant), and the tumor antigen protein may be present at normal levels or reduced levels. In an embodiment, the tumor antigen-expressing cells produced detectable levels of a tumor antigen protein at one point, and subsequently produced substantially no detectable tumor antigen protein. In other embodiments, the disease is a CD19-negative cancer, e.g., a CD19-negative relapsed cancer. In some embodiments, the tumor antigen (e.g., CD19)-expressing cell expresses, or at any time expressed, mRNA encoding the tumor antigen. In an embodiment, the tumor antigen (e.g., CD19)-expressing cell produces the tumor antigen protein (e.g., wild-type or mutant), and the tumor antigen protein may be present at normal levels or reduced levels. In an embodiment, the tumor antigen (e.g., CD19)-expressing cell produced detectable levels of a tumor antigen protein at one point, and subsequently produced substantially no detectable tumor antigen protein.

The term "effector function" refers to a specialized function of a cell. Effector function of a T cell, for example, may be cytolytic activity or helper activity including the secretion of cytokines. The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

The term "endogenous" refers to any material from or produced inside an organism, cell, tissue or system.

The term "exogenous" refers to any material introduced from or produced outside an organism, cell, tissue or system.

The term "expression" refers to the transcription and/or translation of a particular nucleotide sequence driven by a promoter The term "4-1BB" refers to a member of the TNFR superfamily with an amino acid sequence provided as GenBank Acc. No. AAA62478.2, or the equivalent residues from a non-human species, e.g., mouse, rodent, monkey, ape and the like; and a "4-1BB costimulatory domain" is defined as amino acid residues 214-255 of GenBank Acc. No. AAA62478.2, or the equivalent residues from a non-human species, e.g., mouse, rodent, monkey, ape and the like. In one aspect, the "4-1BB costimulatory domain" is the sequence provided as SEQ ID NO:158 or the equivalent residues from a non-human species, e.g., mouse, rodent, monkey, ape and the like.

The term "expression vector" refers to a vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

The compositions and methods of the present invention encompass polypeptides and nucleic acids having the sequences specified, or sequences substantially identical or similar thereto, e.g., sequences at least 85%, 90%, 95% identical or higher to the sequence specified. In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 85%, 90%. 91%, 92%, 93%, 94%, 95%, 96%, 97%, 98% or 99% identity to a reference sequence, e.g., a sequence provided herein.

In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 85%, 90%, 91%, 92%, 93%, 94%, 95%, 96%, 97%, 98% or 99% identity to a reference sequence, e.g., a sequence provided herein.

The term "variant" refers to a polypeptide that has a substantially identical amino acid sequence to the naturally-occurring sequence, or are encoded by a substantially identical nucleotide sequence. In some embodiments, the variant is a functional variant.

The term "functional variant" refers to a polypeptide that has a substantially identical amino acid sequence to the naturally-occurring sequence, or are encoded by a substantially identical nucleotide sequence, and are capable of having one or more activities of the naturally-occurring sequence.

The term "COF1/CRBN-binding variant" of sequence X refers to a polypeptide that: (1) has a substantially identical amino acid sequence to sequence X, and (2) binds to COF1, binds to a complex of COF1 and CRBN, or binds to CRBN in the presence of COF1.

The term "COF2/CRBN-binding variant" of sequence X refers to a polypeptide that: (1) has a substantially identical amino acid sequence to sequence X, and (2) binds to COF2, binds to a complex of COF2 and CRBN, or binds to CRBN in the presence of COF2.

The term "COF3/CRBN-binding variant" of sequence X refers to a polypeptide that: (1) has a substantially identical amino acid sequence to sequence X, and (2) binds to COF3, binds to a complex of COF3 and CRBN, or binds to CRBN in the presence of COF3.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, natural killer (NK) cells, natural killer T (NKT) cells, mast cells, and myeloic-derived phagocytes.

"Immune effector function or immune effector response," as that term is used herein, refers to function or response, e.g., of an immune effector cell, that enhances or promotes an immune attack of a target cell. E.g., an immune effector function or response refers a property of a T or NK cell that promotes killing or the inhibition of growth or proliferation, of a target cell. In the case of a T cell, primary stimulation and co-stimulation are examples of immune effector function or response.

The term "inhibition" or "inhibitor" includes a reduction in a certain parameter, e.g., an activity, of a given molecule, e.g., CD19, CD20, CD10, CD22, CD34, CD123, FLT-3, ROR1, CD79b, CD179b, mesothelin, or CD79a. For example, inhibition of an activity, e.g., an activity of CD20, CD10, CD19, CD22, CD34, CD123, FLT-3, ROR1, CD79b, CD179b, mesothelin, or CD79a, of at least 5%, 10%, 20%, 30%, 40%, or more is included by this term. Thus, inhibition need not be 100%. Activities for the inhibitors can be determined as described herein or by assays known in the art.

An "intracellular signaling domain," as the term is used herein, refers to an intracellular portion of a molecule. The intracellular signaling domain can generate a signal that promotes an immune effector function of the CAR containing cell, e.g., a CART cell. Examples of immune effector function, e.g., in a CART cell, include cytolytic activity and helper activity, including the secretion of cytokines. In embodiments, the intracellular signaling domain is the portion of a protein which transduces the effector function signal and directs the cell to perform a specialized function. While the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal. The term intracellular signaling domain is thus meant to include any truncated portion of the intracellular signaling domain sufficient to transduce the effector function signal.

In an embodiment, the intracellular signaling domain can comprise a primary intracellular signaling domain. Exemplary primary intracellular signaling domains include those derived from the molecules responsible for primary stimulation, or antigen dependent simulation. In an embodiment, the intracellular signaling domain can comprise a costimulatory intracellular domain. Exemplary costimulatory intracellular signaling domains include those derived from molecules responsible for costimulatory signals, or antigen independent stimulation. For example, in the case of a CART, a primary intracellular signaling domain can comprise a cytoplasmic sequence of a T cell receptor, and a costimulatory intracellular signaling domain can comprise cytoplasmic sequence from co-receptor or costimulatory molecule.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, FcR gamma, FcR beta, CD3 gamma, CD3 delta, CD3 epsilon, CD5, CD22, CD79a, CD79b, CD278 ("ICOS"), FcεRI, CD66d, CD32, DAP10 and DAP12.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

As used herein, the term "mesothelin" refers to the 40-kDa protein, mesothelin, which is anchored at the cell membrane by a glycosylphosphatidyl inositol (GPI) linkage and an amino-terminal 31-kDa shed fragment, called megkaryocyte potentiating factor (MPF). Both fragments contain N-glycosylation sites. The term also refers to a soluble splice variant of the 40-kDa carboxyl-terminal fragment also called "soluble mesothelin/MPF-related". Preferably, the term refers to a human mesothelin of GenBank accession number AAH03512.1, and naturally cleaved portions thereof, e.g., as expressed on a cell membrane, e.g., a cancer cell membrane. As used herein, "mesothelin" includes proteins comprising mutations, e.g., point mutations, fragments, insertions, deletions and splice variants of full length wild-type mesothelin.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include introns to the extent that the nucleotide sequence encoding the protein may in some version contain an intron(s)

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "nucleic acid" or "polynucleotide" refers to deoxyribonucleic acids (DNA) or ribonucleic acid (RNA), or a combination of a DNA or RNA thereof, and polymers thereof in either single- or double-stranded form. The term "nucleic acid" includes a gene, cDNA or an mRNA. In one embodiment, the nucleic acid molecule is synthetic (e.g., chemically synthesized) or recombinant. Unless specifically limited, the term encompasses nucleic acids containing analogues or derivatives of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "parenteral" administration of an immunogenic composition includes, e.g., subcutaneous (s.c.), intravenous (i.v.), intramuscular (i.m.), or intrasternal injection, intratumoral, or infusion techniques.

The term "promoter" refers to a DNA sequence recognized by the synthetic machinery of the cell, or introduced synthetic machinery, required to initiate the specific transcription of a polynucleotide sequence.

The term "promoter/regulatory sequence" refers to a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a tissue specific manner.

The term "signaling domain" refers to the functional portion of a protein which acts by transmitting information within the cell to regulate cellular activity via defined signaling pathways by generating second messengers or functioning as effectors by responding to such messengers.

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the fusion polypeptide, the scFv may comprise VL-linker-VH or may comprise VH-linker-VL.

The portion of a CAR comprising an antibody or antibody fragment thereof may exist in a variety of forms where the antigen binding domain is expressed as part of a contiguous polypeptide chain including, for example, a single domain antibody fragment (sdAb), a single chain antibody (scFv) and a humanized antibody (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426). In one embodiment, the antigen binding domain of a CAR comprises an antibody fragment. In a further embodiment, the CAR comprises an antibody fragment that comprises a scFv. As used herein, the term "binding domain" or "antibody molecule" refers to a protein, e.g., an immunoglobulin chain or fragment thereof, comprising at least one immunoglobulin variable domain sequence. The term "binding domain" or "antibody molecule" encompasses antibodies and antibody fragments. In an embodiment, an antibody molecule is a multispecific antibody molecule, e.g., it comprises a plurality of immunoglobulin variable domain sequences, wherein a first immunoglobulin variable domain sequence of the plurality has binding specificity for a first epitope and a second immunoglobulin variable domain sequence of the plurality has binding specificity for a second epitope. In an embodiment, a multispecific antibody molecule is a bispecific antibody molecule. A bispecific antibody has specificity for no more than two antigens. A bispecific antibody molecule is characterized by a first immunoglobulin variable domain sequence which has binding specificity for a first epitope and a second immunoglobulin variable domain sequence that has binding specificity for a second epitope.

The term "stimulation," refers to a primary response induced by binding of a stimulatory molecule (e.g., a TCR/CD3 complex or CAR) with its cognate ligand (e.g., antigen molecule), thereby mediating a signal transduction event, such as, but not limited to, signal transduction via the TCR/CD3 complex or signal transduction via the appropriate NK receptor or signaling domains of the CAR. Stimulation can mediate altered expression of certain molecules.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as immunoreceptor tyrosine-based activation motif or ITAM. Examples of an ITAM containing cytoplasmic signaling sequence that is of particular use in the invention includes, but is not limited to, those derived from CD3 zeta, common FcR gamma (FCER1G), Fc gamma RIIa, FcR beta (Fc Epsilon Rib), CD3 gamma, CD3 delta, CD3 epsilon, CD79a, CD79b, DAP10, and DAP12. In a specific CAR of the invention, the intracellular signaling domain in any one or more CARS of the invention comprises an intracellular signaling sequence, e.g., a primary signaling sequence of CD3-zeta. In a specific CAR of the invention, the primary signaling sequence of CD3-zeta is the sequence provided as SEQ ID NO: 163, or the equivalent residues from a non-human species, e.g., mouse, rodent, monkey, ape and the like. In a specific CAR of the invention, the primary signaling sequence of CD3-zeta is the sequence as provided in SEQ ID NO: 166, or the equivalent residues from a non-human species, e.g., mouse, rodent, monkey, ape and the like.

The term "transfer vector" refers to a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "zeta" or alternatively "zeta chain", "CD3-zeta" or "TCR-zeta" is defined as the protein provided as GenBank Acc. No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain that are sufficient to functionally transmit an initial signal necessary for T cell activation. In one aspect the cytoplasmic domain of zeta comprises residues 52 through 164 of GenBank Acc. No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as SEQ ID NO: 163 (mutant CD3 zeta). In one aspect, the "zeta stimulatory domain" or a "CD3-zeta stimulatory domain" is the sequence provided as SEQ ID NO: 166 (wild-type human CD3 zeta).

The term "constitutive" promoter refers to a nucleotide sequence which, when operably linked with a polynucleotide which encodes or specifies a gene product, causes the gene product to be produced in a cell under most or all physiological conditions of the cell.

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The terms "cancer associated antigen," "tumor antigen," "hyperproliferative disorder antigen," and "antigen associated with a hyperproliferative disorder" interchangeably refer to antigens that are common to specific hyperproliferative disorders. In some embodiments, these terms refer to a molecule (typically a protein, carbohydrate or lipid) that is expressed on the surface of a cancer cell, either entirely or as a fragment (e.g., MHC/peptide), and which is useful for the preferential targeting of a pharmacological agent to the cancer cell. In some embodiments, a tumor antigen is a marker expressed by both normal cells and cancer cells, e.g., a lineage marker, e.g., CD19 on B cells. In some embodiments, a tumor antigen is a cell surface molecule that is overexpressed in a cancer cell in comparison to a normal cell, for instance, 1-fold over expression, 2-fold overexpression, 3-fold overexpression or more in comparison to a normal cell. In some embodiments, a tumor antigen is a cell surface molecule that is inappropriately synthesized in the cancer cell, for instance, a molecule that contains deletions, additions or mutations in comparison to the molecule expressed on a normal cell. In some embodiments, a tumor antigen will be expressed exclusively on the cell surface of a cancer cell, entirely or as a fragment (e.g., MHC/peptide), and not synthesized or expressed on the surface of a normal cell. In certain aspects, the hyperproliferative disorder antigens of the present invention are derived from, cancers including but not limited to primary or metastatic melanoma, thymoma, lymphoma, sarcoma, lung cancer, liver cancer, non-Hodgkin lymphoma, Hodgkin lymphoma, leukemias, uterine cancer, cervical cancer, bladder cancer, kidney cancer and adenocarcinomas such as breast cancer, prostate cancer (e.g., castrate-resistant or therapy-resistant prostate cancer, or metastatic prostate cancer), ovarian cancer, pancreatic cancer, and the like, or a plasma cell proliferative disorder, e.g., asymptomatic myeloma (smoldering multiple myeloma or indolent myeloma), monoclonal gammapathy of undetermined significance (MGUS), Waldenstrom's macroglobulinemia, plasmacytomas (e.g., plasma cell dyscrasia, solitary myeloma, solitary plasmacytoma, extramedullary plasmacytoma, and multiple plasmacytoma), systemic amyloid light chain amyloidosis, and POEMS syndrome (also known as Crow-Fukase syndrome, Takatsuki disease, and PEP syndrome). In some embodiments, the CARs of the present invention include CARs comprising an antigen binding domain (e.g., antibody or antibody fragment) that binds to an MHC presented peptide. Normally, peptides derived from endogenous proteins fill the pockets of Major histocompatibility complex (MHC) class I molecules, and are recognized by T cell receptors (TCRs) on CD8+T lymphocytes. The MHC class I complexes are constitutively expressed by all nucleated cells. In cancer, virus-specific and/or tumor-specific peptide/MHC complexes represent a unique class of cell surface targets for immunotherapy. TCR-like antibodies targeting peptides derived from viral or tumor antigens in the context of human leukocyte antigen (HLA)-A1 or HLA-A2 have been described (see, e.g., Sastry et al., J Virol. 2011 85(5):1935-1942; Sergeeva et al., Blood, 2011 117(16):4262-4272; Verma et al., J Immunol 2010 184(4):2156-2165; Willemsen et al., Gene Ther 2001 8(21):1601-1608; Dao et al., Sci Transl Med 2013 5(176):176ra33; Tassev et al., Cancer Gene Ther 2012 19(2):84-100). For example, TCR-like antibody can be identified from screening a library, such as a human scFv phage displayed library.

The term "flexible polypeptide linker" or "linker" as used refers to a peptide linker that comprises, or consists of, amino acids such as glycine and/or serine residues used alone or in combination, to link two polypeptides together, e.g., a COF1/CRBN-, COF2/CRBN-, or COF3/CRBN-binding polypeptide and a heterologous polypeptide, or a variable heavy and variable light chain regions. In one embodiment, the flexible polypeptide linker is a Gly/Ser linker and comprises the amino acid sequence (Gly-Gly-Gly-Ser)n (SEQ ID NO: 173), where n is a positive integer equal to or greater than 1. For example, n=1, n=2, n=3. n=4, n=5, n=6, n=7, n=8, n=9 and n=10. In one embodiment, the flexible polypeptide linkers include, but are not limited to, (Gly4 Ser)4 (SEQ ID NO: 141) or (Gly4 Ser)3 (SEQ ID NO: 142). In another embodiment, the linkers include multiple repeats of (Gly2Ser), (GlySer) or (Gly3Ser) (SEQ ID NO: 143). Also included within the scope of the invention are linkers described in WO2012/138475, incorporated herein by reference).

As used herein, "transient" refers to expression of a non-integrated transgene for a period of hours, days or weeks, wherein the period of time of expression is less than the period of time for expression of the gene if integrated into the genome or contained within a stable plasmid replicon in the cell. In embodiments, a CAR molecule is transiently expressed in a cell, e.g., host cell, for a finite period of time or number of cell replications, e.g., less than 50 days (e.g., less than 40, 30, 25, 20, 15, 10, 5, 4, 3, 2 or fewer days). In one embodiment, transient expression is effected using an in vitro transcribed RNA.

As used herein, "stable" refers to expression of a transgene that is for a longer period than transient expression. In embodiments, the transgene is integrated into the genome of a cell, e.g., a host cell, or contained within a stable plasmid replicon in the cell. In one embodiment, a transgene is integrated into the cell genome using a gene delivery vector, e.g., a retroviral vector such as a lentivirus vector.

As used herein, the terms "treat", "treatment" and "treating" refer to the reduction or amelioration of the progression, severity and/or duration of a proliferative disorder, or the amelioration of one or more symptoms (e.g., one or more discernible symptoms) of a proliferative disorder resulting from the administration of one or more therapies (e.g., one or more therapeutic agents, such as a CAR of the invention). In specific embodiments, the terms "treat", "treatment" and "treating" refer to the amelioration of at least one measurable physical parameter of a proliferative disorder, such as growth of a tumor, not necessarily discernible by the patient. In other embodiments the terms "treat", "treatment" and "treating"-refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count. Treatment need not be 100%, and in some embodiments a reduction or delay in at least one symptom of the disease or disorder by at least 50%, 60%, 70%, 80%, 90%, 95%, or 99% is sufficient to be considered within these terms.

The term "subject" is intended to include living organisms in which an immune response can be elicited (e.g., mammals, e.g., humans). Examples of subjects include humans, monkeys, chimpanzees, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "specifically binds," refers to an antibody, or a ligand, which recognizes and binds with a cognate binding partner protein present in a sample, but which antibody or ligand does not substantially recognize or bind other molecules in the sample.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity, includes something with 95%, 96%, 97%, 98% or 99% identity, and includes subranges such as 96-99%, 96-98%, 96-97%, 97-99%, 97-98% and 98-99% identity. This applies regardless of the breadth of the range.

Definitions of specific functional groups and chemical terms are described in more detail below. The chemical elements are identified in accordance with the Periodic Table of the Elements, CAS version, *Handbook of Chemistry and Physics*, 75$^{th}$ Ed., inside cover, and specific functional groups are generally defined as described therein. Additionally, general principles of organic chemistry, as well as specific functional moieties and reactivity, are described in Thomas Sorrell, *Organic Chemistry*, University Science Books, Sausalito, 1999; Smith and March, *March's Advanced Organic Chemistry*, 5$^{th}$ Edition, John Wiley & Sons, Inc., New York, 2001; Larock, *Comprehensive Organic Transformations*, VCH Publishers, Inc., New York, 1989; and Carruthers, *Some Modern Methods of Organic Synthesis*, 3$^{rd}$ Edition, Cambridge University Press, Cambridge, 1987.

The term "alkyl," as used herein, refers to a monovalent saturated, straight- or branched-chain hydrocarbon such as a straight or branched group of 1-12, 1-10, or 1-6 carbon atoms, referred to herein as $C_1$-$C_{12}$ alkyl, $C_1$-$C_{10}$ alkyl, and $C_1$-$C_6$ alkyl, respectively. Examples of alkyl groups include, but are not limited to, methyl, ethyl, n-propyl, isopropyl, n-butyl, iso-butyl, sec-butyl, sec-pentyl, iso-pentyl, tert-butyl, n-pentyl, neopentyl, n-hexyl, sec-hexyl, and the like.

The terms "alkenyl" and "alkynyl" as used herein refer to unsaturated aliphatic groups analogous in length and possible substitution to the alkyls described above, but that contain at least one double or triple bond, respectively. Exemplary alkenyl groups include, but are not limited to, —CH=$CH_2$ and —$CH_2$CH=$CH_2$.

The term "alkoxy" as used herein refers to a straight or branched chain saturated hydrocarbon containing 1-12 carbon atoms containing a terminal "O" in the chain, e.g., —O(alkyl). Examples of alkoxy groups include, without limitation, methoxy, ethoxy, propoxy, butoxy, t-butoxy, or pentoxy groups.

The term "aryl" as used herein refers to a monocyclic, bicyclic or polycyclic hydrocarbon ring system, wherein at least one ring is aromatic. Representative aryl groups include fully aromatic ring systems, such as phenyl (e.g., ($C_6$) aryl), naphthyl (e.g., ($C_{10}$) aryl), and anthracenyl (e.g., ($C_{14}$) aryl), and ring systems where an aromatic carbon ring is fused to one or more non-aromatic carbon rings, such as indanyl, phthalimidyl, naphthimidyl, or tetrahydronaphthyl, and the like.

The term "carbocyclyl" as used herein refers to monocyclic, or fused, spiro-fused, and/or bridged bicyclic or polycyclic hydrocarbon ring system containing 3-18 carbon atoms, wherein each ring is either completely saturated or contains one or more units of unsaturation, but where no ring is aromatic. Representative carbocyclyl groups include cycloalkyl groups (e.g., cyclopentyl, cyclobutyl, cyclopentyl, cyclohexyl and the like), and cycloalkenyl groups (e.g., cyclopentenyl, cyclohexenyl, cyclopentadienyl, and the like).

The term "carbonyl" as used herein refers to —C=O.

The term "cyano" as used herein refers to —CN.

The terms "halo" or "halogen" as used herein refer to fluorine (fluoro, —F), chlorine (chloro, —Cl), bromine (bromo, —Br), or iodine (iodo, —I).

The term "haloalkyl" as used herein refers to a monovalent saturated straight or branched alkyl chain wherein at least one carbon atom in the chain is substituted with one or more halogen atoms. In some embodiments, a haloalkyl group may comprise, e.g., 1-12, 1-10, or 1-6 carbon atoms, referred to herein as $C_1$-$C_{12}$haloalkyl, haloalkyl, and $C_1$-$C_6$haloalkyl. Examples of haloalkyl groups include, but are not limited to, trifluoromethyl, difluoromethyl, pentafluoroethyl, trichloromethyl, etc.

The term "haloalkoxy" to a straight or branched chain saturated hydrocarbon containing 1-12 carbon atoms containing a terminal "O" in the chain, wherein at least one carbon atom in the chain is substituted with one or more halogens. Examples of haloalkoxy groups include, but are not limited to, trifluoromethoxy, difluoromethoxy, pentafluoroethoxy, trichloromethoxy, etc.

The term "heteroalkyl" as used herein refers to a monovalent saturated straight or branched alkyl chain wherein at least one carbon atom in the chain is replaced with a heteroatom, such as O, S, or N, provided that upon substitution, the chain comprises at least one carbon atom. In some embodiments, a heteroalkyl group may comprise, e.g., 1-12, 1-10, or 1-6 carbon atoms, referred to herein as $C_1$-$C_{12}$ heteroalkyl, $C_1$-$C_{10}$ heteroalkyl, and $C_1$-$C_6$ heteroalkyl. In certain instances, a heteroalkyl group comprises 1, 2, 3, or 4 independently selected heteroatoms in place of 1, 2, 3, or 4 individual carbon atoms in the alkyl chain. Representative heteroalkyl groups include —CH$_2$NHC(O)CH$_3$, —CH$_2$CH$_2$OCH$_3$, —CH$_2$CH$_2$NHCH$_3$, —CH$_2$CH$_2$N(CH$_3$)CH$_3$, and the like.

The terms "alkylene," "alkenylene", "alkynylene," and "heteroalkylene" as used herein refer to a divalent radical of an alkyl, alkenyl, alkynyl, or heteroalkyl group, respectively. Any of a monovalent alkyl, alkenyl, alkynyl, or heteroalkyl group may be an alkylene, alkenylene, alkynylene, or heteroalkylene by abstraction of a second hydrogen atom from the alkyl, alkenyl, alkynyl, or heteroalkyl group.

The term "heteroaryl" as used herein refers to a monocyclic, bicyclic or polycyclic ring system wherein at least one ring is both aromatic and comprises a heteroatom; and wherein no other rings are heterocyclyl (as defined below). Representative heteroaryl groups include ring systems where (i) each ring comprises a heteroatom and is aromatic, e.g., imidazolyl, oxazolyl, thiazolyl, triazolyl, pyrrolyl, furanyl, thiophenyl pyrazolyl, pyridinyl, pyrazinyl, pyridazinyl, pyrimidinyl, indolizinyl, purinyl, naphthyridinyl, and pteridinyl; (ii) each ring is aromatic or carbocyclyl, at least one aromatic ring comprises a heteroatom and at least one other ring is a hydrocarbon ring or e.g., indolyl, isoindolyl, benzothienyl, benzofuranyl, dibenzofuranyl, indazolyl, benzimidazolyl, benzthiazolyl, quinolyl, isoquinolyl, cinnolinyl, phthalazinyl, quinazolinyl, quinoxalinyl, carbazolyl, acridinyl, phenazinyl, phenothiazinyl, phenoxazinyl, pyrido[2,3-b]-1,4-oxazin-3(4H)-one, thiazolo-[4,5-c]-pyridinyl, 4,5,6,7-tetrahydrothieno[2,3-c]pyridinyl, 5,6-dihydro-4H-thieno[2,3-c]pyrrolyl, 4,5,6,7,8-tetrahydroquinolinyl and 5,6,7,8-tetrahydroisoquinolinyl; and (iii) each ring is aromatic or carbocyclyl, and at least one aromatic ring shares a bridgehead heteroatom with another aromatic ring, e.g., 4H-quinolizinyl. In certain embodiments, the heteroaryl is a monocyclic or bicyclic ring, wherein each of said rings contains 5 or 6 ring atoms where 1, 2, 3, or 4 of said ring atoms are a heteroatom independently selected from N, O, and S.

The term "heterocyclyl" as used herein refers to a monocyclic, or fused, spiro-fused, and/or bridged bicyclic and polycyclic ring systems where at least one ring is saturated or partially unsaturated (but not aromatic) and comprises a heteroatom. A heterocyclyl can be attached to its pendant group at any heteroatom or carbon atom that results in a stable structure and any of the ring atoms can be optionally substituted. Representative heterocyclyls include ring systems in which (i) every ring is non-aromatic and at least one ring comprises a heteroatom, e.g., tetrahydrofuranyl, tetrahydrothienyl, pyrrolidinyl, pyrrolidonyl, piperidinyl, pyrrolinyl, decahydroquinolinyl, oxazolidinyl, piperazinyl, dioxanyl, dioxolanyl, diazepinyl, oxazepinyl, thiazepinyl, morpholinyl, and quinuclidinyl; (ii) at least one ring is non-aromatic and comprises a heteroatom and at least one other ring is an aromatic carbon ring, e.g., 1,2,3,4-tetrahydroquinolinyl; and (iii) at least one ring is non-aromatic and comprises a heteroatom and at least one other ring is aromatic and comprises a heteroatom, e.g., 3,4-dihydro-1H-pyrano[4,3-c]pyridinyl, and 1,2,3,4-tetrahydro-2,6-naphthyridinyl. In certain embodiments, the heterocyclyl is a monocyclic or bicyclic ring, wherein each of said rings contains 3-7 ring atoms where 1, 2, 3, or 4 of said ring atoms are a heteroatom independently selected from N, O, and S.

As described herein, compounds of the invention may contain "optionally substituted" moieties. In general, the term "substituted", whether preceded by the term "optionally" or not, means that one or more hydrogens of the designated moiety are replaced with a suitable substituent. Unless otherwise indicated, an "optionally substituted" group may have a suitable substituent at each substitutable position of the group, and when more than one position in any given structure may be substituted with more than one substituent selected from a specified group, the substituent may be either the same or different at each position. Combinations of substituents envisioned under this invention are preferably those that result in the formation of stable or chemically feasible compounds. The term "stable", as used herein, refers to compounds that are not substantially altered when subjected to conditions to allow for their production, detection, and, in certain embodiments, their recovery, purification, and use for one or more of the purposes disclosed herein.

The term "oxo" as used herein refers to =O.

The term "thiocarbonyl" as used herein refers to C=S.

As used herein, the term "pharmaceutically acceptable salt" refers to those salts which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, Berge et al., describe pharmaceutically acceptable salts in detail in J. Pharmaceutical Sciences, 1977, 66, 1-19, incorporated herein by reference. Pharmaceutically acceptable salts of the compounds of this invention include those derived from suitable inorganic and organic acids and bases. Examples of pharmaceutically acceptable, nontoxic acid addition salts are salts of an amino group formed with inorganic acids such as hydrochloric acid, hydrobromic acid, phosphoric acid, sulfuric acid, and perchloric acid or with organic acids such as acetic acid, oxalic acid, maleic acid, tartaric acid, citric acid, succinic acid, or malonic acid or by using other methods known in the art such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Salts derived from appropriate bases include alkali metal, alkaline earth metal, ammonium and N+($C_{1-4}$ alkyl)$_4^-$ salts. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate, and aryl sulfonate.

The term "solvate" refers to forms of the compound that are associated with a solvent, usually by a solvolysis reaction. This physical association may include hydrogen bonding. Conventional solvents include water, methanol, ethanol, acetic acid, DMSO, THF, diethyl ether, and the like. The compounds of Formula (I), Formula (I-a), and/or Formula (II) may be prepared, e.g., in crystalline form, and may be solvated. Suitable solvates include pharmaceutically acceptable solvates and further include both stoichiometric solvates and non-stoichiometric solvates. In certain instances, the solvate will be capable of isolation, for example, when one or more solvent molecules are incorporated in the crystal lattice of a crystalline solid. "Solvate" encompasses both solution-phase and isolable solvates. Representative solvates include hydrates, ethanolates, and methanolates.

The term "hydrate" refers to a compound which is associated with water. Typically, the number of the water molecules contained in a hydrate of a compound is in a definite ratio to the number of the compound molecules in the hydrate. Therefore, a hydrate of a compound may be represented, for example, by the general formula R·x H$_2$O, wherein R is the compound and wherein x is a number greater than 0. A given compound may form more than one type of hydrates, including, e.g., monohydrates (x is 1), lower hydrates (x is a number greater than 0 and smaller than 1, e.g., hemihydrates (R·0.5H$_2$O)), and polyhydrates (x is a number greater than 1, e.g., dihydrates (R·2H$_2$O) and hexahydrates (R·6H$_2$O)).

It is to be understood that compounds that have the same molecular formula but differ in the nature or sequence of bonding of their atoms or the arrangement of their atoms in space are termed "isomers". Isomers that differ in the arrangement of their atoms in space are termed "stereoisomers".

Stereoisomers that are not mirror images of one another are termed "diastereomers" and those that are non-superimposable mirror images of each other are termed "enantiomers". When a compound has an asymmetric center, for example, it is bonded to four different groups and a pair of enantiomers is possible. An enantiomer can be characterized by the absolute configuration of its asymmetric center and is described by the R- and S-sequencing rules of Cahn and Prelog, or by the manner in which the molecule rotates the plane of polarized light and designated as dextrorotatory or levorotatory (i.e., as (+) or (−)-isomers respectively). A chiral compound can exist as either individual enantiomer or as a mixture thereof. A mixture containing equal proportions of the enantiomers is called a "racemic mixture".

The term "tautomers" refer to compounds that are interchangeable forms of a particular compound structure, and that vary in the displacement of hydrogen atoms and electrons. Thus, two structures may be in equilibrium through the movement of 7E electrons and an atom (usually H). For example, enols and ketones are tautomers because they are rapidly interconverted by treatment with either acid or base. Another example of tautomerism is the aci- and nitro-forms of phenylnitromethane that are likewise formed by treatment with acid or base.

Tautomeric forms may be relevant to the attainment of the optimal chemical reactivity and biological activity of a compound of interest.

Unless otherwise stated, structures depicted herein are also meant to include all isomeric (e.g., enantiomeric, diastereomeric, and geometric (or conformational)) forms of the structure; for example, the R and S configurations for each asymmetric center, Z and E double bond isomers, and Z and E conformational isomers. Therefore, single stereochemical isomers as well as enantiomeric, diastereomeric, and geometric (or conformational) mixtures of the present compounds are within the scope of the invention. Unless otherwise stated, all tautomeric forms of the compounds of the invention are within the scope of the invention. Additionally, unless otherwise stated, structures depicted herein are also meant to include compounds that differ only in the presence of one or more isotopically enriched atoms. For example, compounds having the present structures including the replacement of hydrogen by deuterium or tritium, or the replacement of a carbon by a $^{13}$C- or $^{14}$C-enriched carbon are within the scope of this invention. In an embodiment, the hydrogen atoms present within any one of the compounds disclosed herein (for example, a compound of Formula (I)) are isotopically enriched in deuterium. Such compounds are useful, for example, as analytical tools, as probes in biological assays, or as therapeutic agents in accordance with the present invention.

Where a particular enantiomer is preferred, it may, in some embodiments be provided substantially free of the corresponding enantiomer, and may also be referred to as "optically enriched." "Optically-enriched," as used herein, means that the compound is made up of a significantly greater proportion of one enantiomer. In certain embodiments the compound is made up of at least about 90% by weight of a preferred enantiomer. In other embodiments the compound is made up of at least about 95%, 98%, or 99% by weight of a preferred enantiomer. Preferred enantiomers may be isolated from racemic mixtures by any method known to those skilled in the art, including chiral high pressure liquid chromatography (HPLC) and the formation and crystallization of chiral salts or prepared by asymmetric syntheses. See, for example, Jacques et al., *Enantiomers, Racemates and Resolutions* (Wiley Interscience, New York, 1981); Wilen, et al., *Tetrahedron* 33:2725 (1977); Eliel, E. L. *Stereochemistry of Carbon Compounds* (McGraw-Hill, N Y, 1962); Wilen, S. H. *Tables of Resolving Agents and Optical Resolutions* p. 268 (E. L. Eliel, Ed., Univ. of Notre Dame Press, Notre Dame, IN 1972).

These and other exemplary substituents are described in more detail in the Detailed Description, Figures, Examples, and Claims. The invention is not intended to be limited in any manner by the above exemplary listing of substituents.

COF1/CRBN-Binding Polypeptide, COF2/CRBN-Binding Polypeptide, or COF3/CRBN-Binding Polypeptide Disclosed herein are, inter alia, fusion polypeptides that include a compound of Formula (I) (COF1)/CRBN-binding polypeptide, a compound of Formula (II) (COF2)/CRBN-binding polypeptide, or a compound of Formula (III) (COF3)/CRBN-binding polypeptide. In embodiments, in the presence of COF1 or COF2 (e.g., thalidomide and derivatives thereof, e.g., lenalidomide, pomalidomide, and thalidomide), or in the presence of COF3 (e.g., a compound disclosed in Table 29), the COF1/CRBN-, COF2/CRBN-, or COF3/CRBN-binding polypeptide in the fusion polypeptide increases a post-translational modification and/or degradation of the fusion polypeptide. In some embodiments, post-translational modification can include ubiquitination (e.g., mono- or poly-ubiquitination) of one or more amino acid residues, e.g., one or more of lysine or methionine, in the fusion polypeptide (e.g., one or all of: all or a part of a heterologous polypeptide and/or the COF1/CRBN-, COF2/CRBN-, or COF3/CRBN-binding polypeptide).

In certain embodiments, one or more lysine residues of the fusion polypeptide (e.g., all or a part of a heterologous polypeptide and/or the COF1/CRBN-, COF2/CRBN-, or COF3/CRBN-binding polypeptide) are ubiquitinated. In some embodiments, one or more methionine residues of the fusion polypeptide (e.g., all or a part of a heterologous polypeptide and/or the COF1/CRBN-, COF2/CRBN-, or COF3/CRBN-binding polypeptide) are ubiquitinated (e.g., mono- or poly-ubiquitinated).

Without wishing to be bound by theory, in some embodiments, inactivation, e.g., degradation, of a fusion polypeptide described herein can include one, two, three or all of following steps, e.g., in a cell or a reaction mixture:

(1) association of the fusion polypeptide that comprises the COF1/CRBN-, COF2/CRBN-, or COF3/CRBN-binding polypeptide to one or more subunits (e.g., CRBN) of a ubiquitin ligase complex (e.g., an E3 ubiquitin ligase complex) in the presence of COF1 or COF2 (e.g., thalidomide and derivatives thereof (e.g., lenalidomide)) or in the presence of COF3 (e.g., a compound disclosed in Table 29);

(2) ubiquitination of the fusion polypeptide (e.g., ubiquitination at a heterologous polypeptide and/or the COF1/CRBN-, COF2/CRBN-, or COF3/CRBN-binding polypeptide), thereby providing a ubiquitinated fusion polypeptide; and (3) degradation of the ubiquitinated fusion polypeptide.

In some embodiments, any COF1/CRBN-, COF2/CRBN-, or COF3/CRBN-binding polypeptide described herein increases a post-translational modification and/or degradation of the fusion polypeptide in the presence of COF1, COF2, or COF3, e.g., relative to the modification and/or degradation in the absence of COF1, COF2, or COF3. In one embodiment, the COF1/CRBN-, COF2/CRBN-, or COF3/CRBN-binding polypeptide increases selective ubiquitination of the fusion polypeptide in the presence of COF1, COF2, or COF3, e.g., relative to the ubiquitination in the absence of COF1, COF2, or COF3.

In some embodiments, a COF1/CRBN-, COF2/CRBN-, or COF3/CRBN-binding polypeptide is derived from an amino acid sequence and/or structural motif (e.g., a domain) that binds to one or more components of a ubiquitin ligase complex (e.g., the E3 ubiquitin ligase complex) in the presence of COF1, COF2, or COF3. In some embodiments, COF1 or COF2 is a thalidomide class of compounds (e.g., lenalidomide, pomalidomide, and thalidomide), e.g., as described herein. In some embodiments, COF3 is a compound disclosed in Table 29. In some embodiments, the COF1/CRBN-, COF2/CRBN-, or COF3/CRBN-binding polypeptide comprises a zinc finger domain (e.g., a zinc finger 2 domain) or a portion thereof. In some embodiments, the COF1/CRBN-, COF2/CRBN-, or COF3/CRBN-binding polypeptide comprises a β turn. In some embodiments, the COF1/CRBN- or COF2/CRBN-binding polypeptide comprises a β turn of an Ikaros family of transcription factors, e.g., IKZF1 or IKZF3, or a sequence substantially identical thereto (e.g., at least 85%, 87, 90, 95, 97, 98, 99, or 100% identical thereto). In some embodiments, the COF1/CRBN- or COF2/CRBN-binding polypeptide comprises a β hairpin of an Ikaros family of transcription factors, e.g., IKZF1 or IKZF3, or a sequence substantially identical thereto (e.g., at least 85%, 87, 90, 95, 97, 98, 99, or 100% to a β hairpin of IKZF1 or IKZF3, e.g., as described in Kronke, J. et al. (2014) *Science* 343(6168):301-5). In some embodiments, the COF3/CRBN-binding polypeptide comprises a β turn of IKZF2, or a sequence substantially identical thereto (e.g., at least 85%, 87, 90, 95, 97, 98, 99, or 100% identical thereto). In some embodiments, the COF3/CRBN-binding polypeptide comprises a β hairpin of IKZF2, or a sequence substantially identical thereto (e.g., at least 85%, 87, 90, 95, 97, 98, 99, or 100% identical thereto).

In some embodiments, the COF1/CRBN- or COF2/CRBN-binding polypeptide comprises about 10 to about 95 amino acid residues, about 15 to about 90 amino acid residues, about 20 to about 85 amino acid residues, about 25 to about 80 amino acid residues, about 30 to about 75 amino acid residues, about 35 to about 70 amino acid residues, about 40 to about 65 amino acid residues, about 45 to about 65 amino acid residues, about 50 to about 65 amino acid residues, or about 55 to about 65 amino acid residues of IKZF1 (e.g., SEQ ID NO: 20) or IKZF3 (e.g., SEQ ID NO: 19) or a sequence substantially identical thereto (e.g., at least 85%, 87, 90, 95, 97, 98, 99, or 100% identical thereto). In some embodiments, the COF1/CRBN- or COF2/CRBN-binding polypeptide comprises at least 10 amino acids, at least 15 amino acids, at least 20 amino acids, at least 25 amino acids, at least 30 amino acids, at least 35 amino acids, at least 40 amino acids, at least 45 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 90 amino acids, or at least 95 amino acids of IKZF1 (e.g., SEQ ID NO: 20) or IKZF3 (e.g., SEQ ID NO: 19), or a sequence substantially identical thereto (e.g., at least 85%, 87, 90, 95, 97, 98, 99, or 100% identical thereto). In some embodiments, the COF1/CRBNor COF2/CRBN-binding polypeptide comprises or consists of the amino acid sequences selected from the group consisting of SEQ ID NOs: 1-6, 11-15, 40, 41-43, 77, 78, 84-86, and 100.

In some embodiments, the COF3/CRBN-binding polypeptide comprises about 10 to about 95 amino acid residues, about 15 to about 90 amino acid residues, about 20 to about 85 amino acid residues, about 25 to about 80 amino acid residues, about 30 to about 75 amino acid residues, about 35 to about 70 amino acid residues, about 40 to about 65 amino acid residues, about 45 to about 65 amino acid residues, about 50 to about 65 amino acid residues, or about 55 to about 65 amino acid residues of IKZF2 (e.g., SEQ ID NO: 21) or a sequence substantially identical thereto (e.g., at least 85%, 87, 90, 95, 97, 98, 99, or 100% identical thereto). In some embodiments, the COF3/CRBN-binding polypeptide comprises at least 10 amino acids, at least 15 amino acids, at least 20 amino acids, at least 25 amino acids, at least 30 amino acids, at least 35 amino acids, at least 40 amino acids, at least 45 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 90 amino acids, or at least 95 amino acids of IKZF2 (e.g., SEQ ID NO: 21), or a sequence substantially identical thereto (e.g., at least 85%, 87, 90, 95, 97, 98, 99, or 100% identical thereto). In some embodiments, the COF3/CRBN-binding polypeptide comprises or consists of the amino acid sequences selected from the group consisting of SEQ ID NOs: 109, 113, and 114.

In some embodiments, exemplary full-length sequences of IKZF1, IKZF2, IKZF3, IKZF4, and IKZF5 or fragment thereof are provided in Table 1.

TABLE 1

Exemplary IKZF sequences, variants, or fragments

| SEQ ID NO | Comment | Sequence |
|---|---|---|
| SEQ ID NO: 1 | IKZF3 136-180 and 236-249 (with N-terminal methionine) | MHKRSHTGERPFQCNQCGASFTQKGNLLRHIKLHTGEKPFKCHLCNTASAEARHIKAEMG |
| SEQ ID NO: 3 | IKZF3 136-180 and 236-249 (without N-terminal methionine) | HKRSHTGERPFQCNQCGASFTQKGNLLRHIKLHTGEKPFKCHLCNTASAEARHIKAEMG |
| SEQ ID NO: 2 | Lysine-free IKZF3 136-180 and 236-249 variant (with N-terminal methionine) | MHRRSHTGERPFQCNQCGASFTQRGNLLRHIRLHTGERPFRCHLCNTASAEARHIRAEMG |
| SEQ ID NO: 4 | Lysine-free IKZF3 136-180 and 236-249 variant (without N-terminal methionine) | HRRSHTGERPFQCNQCGASFTQRGNLLRHIRLHTGERPFRCHLCNTASAEARHIRAEMG |
| SEQ ID NO: 77 | IKZF3 136-180 (with N-terminal methionine) | MHKRSHTGERPFQCNQCGASFTQKGNLLRHIKLHTGEKPFKCHLCN |
| SEQ ID NO: 5 | IKZF3 136-180 (without N-terminal methionine) | HKRSHTGERPFQCNQCGASFTQKGNLLRHIKLHTGEKPFKCHLCN |
| SEQ ID NO: 41 | Lysine-free IKZF3 136-180 | HRRSHTGERPFQCNQCGASFTQRGNLLRHIRLHTGERPFRCHLCN |
| SEQ ID NO: 78 | IKZF3 136-170 (with N-terminal methionine) | MHKRSHTGERPFQCNQCGASFTQKGNLLRHIKLHTG |
| SEQ ID NO: 6 | IKZF3 136-170 (without N-terminal methionine) | HKRSHTGERPFQCNQCGASFTQKGNLLRHIKLHTG |
| SEQ ID NO: 42 | Lysine-free IKZF3 136-170 | HRRSHTGERPFQCNQCGASFTQRGNLLRHIRLHTG |
| SEQ ID NO: 79 | IKZF3 140-170 (with N-terminal methionine) | MHTGERPFQCNQCGASFTQKGNLLRHIKLHTG |
| SEQ ID NO: 7 | IKZF3 140-170 (without N-terminal methionine) | HTGERPFQCNQCGASFTQKGNLLRHIKLHTG |
| SEQ ID NO: 80 | IKZF3 140-169 (with N-terminal methionine) | MHTGERPFQCNQCGASFTQKGNLLRHIKLHT |
| SEQ ID NO: 24 | IKZF3 140-169 (without N-terminal methionine) | HTGERPFQCNQCGASFTQKGNLLRHIKLHT |
| SEQ ID NO: 81 | IKZF3 141-163 (with N-terminal methionine) | MTGERPFQCNQCGASFTQKGNLLR |
| SEQ ID NO: 8 | IKZF3 141-163 (without N-terminal methionine) | TGERPFQCNQCGASFTQKGNLLR |

TABLE 1-continued

Exemplary IKZF sequences, variants, or fragments

| SEQ ID NO | Comment | Sequence |
|---|---|---|
| SEQ ID NO: 82 | IKZF3 145-170 (with N-terminal methionine) | MPFQCNQCGASFTQKGNLLRHIKLHTG |
| SEQ ID NO: 9 | IKZF3 145-170 (without N-terminal methionine) | PFQCNQCGASFTQKGNLLRHIKLHTG |
| SEQ ID NO: 83 | IKZF3 145-155 (with N-terminal methionine) | MPFQCNQCGASF |
| SEQ ID NO: 10 | IKZF3 145-155 (without N-terminal methionine) | PFQCNQCGASF |
| SEQ ID NO: 11 | IKZF3 236-249 | TASAEARHIKAEMG |
| SEQ ID NO: 43 | Lysine-free IKZF3 236-249 | TASAEARHIRAEMG |
| SEQ ID NO: 12 | IKZF3 136-180 and 236-249 K245R (with N-terminal methionine) | MHKRSHTGERPFQCNQCGASFTQKGNLLRHIKLHTGEKPFKCHLCNTASAEARHIRAEMG |
| SEQ ID NO: 84 | IKZF3 136-180 and 236-249 K245R (without N-terminal methionine) | HKRSHTGERPFQCNQCGASFTQKGNLLRHIKLHTGEKPFKCHLCNTASAEARHIRAEMG |
| SEQ ID NO: 13 | IKZF3 136-180 and 236-249 K245S (with N-terminal methionine) | MHKRSHTGERPFQCNQCGASFTQKGNLLRHIKLHTGEKPFKCHLCNTASAEARHISAEMG |
| SEQ ID NO: 100 | IKZF3 136-180 and 236-249 K245S (without N-terminal methionine) | HKRSHTGERPFQCNQCGASFTQKGNLLRHIKLHTGEKPFKCHLCNTASAEARHISAEMG |
| SEQ ID NO: 14 | IKZF3 136-180 MALEK (with N-terminal methionine) | MHKRSHTGERPFQCNQCGASFTQKGNLLRHIKLHTGEKPFKCHLCNMALEKMALEKMALE |
| SEQ ID NO: 85 | IKZF3 136-180 MALEK (without N-terminal methionine) | HKRSHTGERPFQCNQCGASFTQKGNLLRHIKLHTGEKPFKCHLCNMALEKMALEKMALE |
| SEQ ID NO: 15 | IKZF3 136-170 MALEK (with N-terminal methionine) | MHKRSHTGERPFQCNQCGASFTQKGNLLRHIKLHTGMALEKMALEKMALE |
| SEQ ID NO: 86 | IKZF3 136-170 MALEK (without N-terminal methionine) | HKRSHTGERPFQCNQCGASFTQKGNLLRHIKLHTGMALEKMALEKMALE |
| SEQ ID NO: 16 | IKZF3 140-170 MALEK (with N-terminal methionine) | MHTGERPFQCNQCGASFTQKGNLLRHIKLHTGMALEKMALEKMALE |
| SEQ ID NO: 87 | IKZF3 140-170 MALEK (without N-terminal methionine) | HTGERPFQCNQCGASFTQKGNLLRHIKLHTGMALEKMALEKMALE |
| SEQ ID NO: 17 | IKZF3 141-163 MALEK (with N-terminal methionine) | MTGERPFQCNQCGASFTQKGNLLRMALEKMALEKMALE |
| SEQ ID NO: 88 | IKZF3 141-163 MALEK (without N-terminal methionine) | TGERPFQCNQCGASFTQKGNLLRMALEKMALEKMALE |
| SEQ ID NO: 18 | IKZF3 145-155 MALEK (with N-terminal methionine) | MPFQCNQCGASFMALEKMALEKMALE |
| SEQ ID NO: 89 | IKZF3 145-155 MALEK (without N-terminal methionine) | PFQCNQCGASFMALEKMALEKMALE |

TABLE 1-continued

Exemplary IKZF sequences, variants, or fragments

| SEQ ID NO | Comment | Sequence |
|---|---|---|
| SEQ ID NO: 27 | IKZF3 136-180 Q147H (with N-terminal methionine) | MHKRSHTGERPFHCNQCGASFTQKGNLLRHIKLHTGE KPFKCHLCN |
| SEQ ID NO: 90 | IKZF3 136-180 Q147H (without N-terminal methionine) | HKRSHTGERPFHCNQCGASFTQKGNLLRHIKLHTGEKP FKCHLCN |
| SEQ ID NO: 109 | IKZF2 130-174 and 230-243 | HKRSHTGERPFHCNQCGASFTQKGNLLRHIKLHSGEKP FKCPFCSAGQVMSHHVPPMED |
| SEQ ID NO: 113 | IKZF2 130-174 | HKRSHTGERPFHCNQCGASFTQKGNLLRHIKLHSGEKP FKCPFCS |
| SEQ ID NO: 114 | IKZF2 230-243 | AGQVMSHHVPPMED |
| SEQ ID NO: 19 | IKZF3 full length | MEDIQTNAELKSTQEQSVPAESAAVLNDYSLTKSHEME NVDSGEGPANEDEDIGDDSMKVKDEYSERDENVLKSE PMGNAEEPEIPYSYSREYNEYENIKLERHVVSFDSSRPT SGKMNCDVCGLSCISFNVLMVHKRSHTGERPFQCNQC GASFTQKGNLLRHIKLHTGEKPFKCHLCNYACQRRDAL TGHLRTHSVEKPYKCEFCGRSYKQRSSLEEHKERCRTF LQSTDPGDTASAEARHIKAEMGSERALVLDRLASNVA KRKSSMPQKFIGEKRHCFDVNYNSSYMYEKESELIQTR MMDQAINNAISYLGAEALRPLVQTPPAPTSEMVPVISS MYPIALTRAEMSNGAPQELEKKSIHLPEKSVPSERGLSP NNSGHDSTDTDSNHEERQNHIYQQNHMVLSRARNGMP LLKEVPRSYELLKPPPICPRDSVKVINKEGEVMDVYRC DHCRVLFLDYVMFTIHMGCHGFRDPFECNMCGYRSHD RYEFSSHIARGEHRALLK |
| SEQ ID NO: 20 | IKZF1 full length | MDADEGQDMSQVSGKESPPVSDTPDEGDEPMPIPEDLS TTSGGQQSSKSDRVVASNVKVETQSDEENGRACEMNG EECAEDLRMLDASGEKMNGSHRDQGSSALSGVGGIRL PNGKLKCDICGIICIGPNVLMVHKRSHTGERPFQCNQCG ASFTQKGNLLRHIKLHSGEKPFKCHLCNYACRRRDALT GHLRTHSVGKPHKCGYCGRSYKQRSSLEEHKERCHNY LESMGLPGTLYPVIKEETNHSEMAEDLCKIGSERSLVLD RLASNVAKRKSSMPQKFLGDKGLSDTPYDSSASYEKEN EMMKSHVMDQAINNAINYLGAESLRPLVQTPPGGSEV VPVISPMYQLHKPLAEGTPRSNHSAQDSAVENLLLLSK AKLVPSEREASPSNSCQDSTDTESNNEEQRSGLIYLTNH IAPHARNGLSLKEEHRAYDLLRAASENSQDALRVVSTS GEQMKVYKCEHCRVLFLDHVMYTIHMGCHGFRDPFEC NMCGYHSQDRYEFSSHITRGEHRFHMS |
| SEQ ID NO: 21 | IKZF2 full length | METEAIDGYITCDNELSPEREHSNMAIDLTSSTPNGQHA SPSHMTSTNSVKLEMQSDEECDRKPLSREDEIRGHDEG SSLEEPLIESSEVADNRKVQELQGEGGIRLPNGKLKCDV CGMVCIGPNVLMVHKRSHTGERPFHCNQCGASFTQKG NLLRHIKLHSGEKPFKCPFCSYACRRRDALTGHLRTHS VGKPHKCNYCGRSYKQRSSLEEHKERCHNYLQNVSME AAGQVMSHHVPPMEDCKEQEPIMDNNISLVPFERPAVI EKLTGNMGKRKSSTPQKFVGEKLMRFSYPDIHFDMNL TYEKEAELMQSHMMDQAINNAITYLGAEALHPLMQHP PSTIAEVAPVISSAYSQVYHPNRIERPISRETADSHENNM DGPISLIRPKSRPQEREASPSNSCLDSTDSESSHDDHQSY QGHPALNPKRKQSPAYMKEDVKALDTTKAPKGSLKDI YKVFNGEGEQIRAFKCEHCRVLFLDHVMYTIHMGCHG YRDPLECNICGYRSQDRYEFSSHIVRGEHTFH |
| SEQ ID NO: 22 | IKZF4 full length | MHTPPALPRRFQGGGRVRTPGSHRQGKDNLERDPSGG CVPDFLPQAQDSNHFIMESLFCESSGDSSLEKEFLGAPV GPSVSTPNSQHSSPSRSLSANSIKVEMYSDEESSRLLGPD ERLLEKDDSVIVEDSLSEPLGYCDGSGPEPHSPGGIRLPN GKLKCDVCGMVCIGPNVLMVHKRSHTGERPFHCNQCG ASFTQKGNLLRHIKLHSGEKPFKCPFCNYACRRRDALT GHLRTHSVSSPTVGKPYKCNYCGRSYKQQSTLEEHKER CHNYLQSLSTEAQALAGQPGDEIRDLEMVPDSMLHSSS ERPTFIDRLANSLTKRKRSTPQKFVGEKQMRFSLSDLPY DVNSGGYEKDVELVAHHSLEPGFGSSLAFVGAEHLRPL RLPPTNCISELTPVISSVYTQMQPLPGRLELPGSREAGEG PEDLADGGPLLYRPRGPLTDPGASPSNGCQDSTDTESN HEDRVAGVVSLPQGPPPQPPPTIVVGRHSPAYAKEDPK |

TABLE 1-continued

Exemplary IKZF sequences, variants, or fragments

| SEQ ID NO | Comment | Sequence |
|---|---|---|
| | | PQEGLLRGTPGPSKEVLRVVGESGEPVKAFKCEHCRILF LDHVMFTIHMGCHGFRDPFECNICGYHSQDRYEFSSHI VRGEHKVG |
| SEQ ID NO: 23 | IKZF5 full length | MGEKKPEPLDFVKDFQEYLTQQTHHVNMISGSVSGDK EAEALQGAGTDGDQNGLDHPSVEVSLDENSGMLVDGF ERTFDGKLKCRYCNYASKGTARLIEHIRIHTGEKPHRCH LCPFASAYERHLEAHMRSHTGEKPYKCELCSFRCSDRS NLSHHRRRKHKMVPIKGTRSSLSSKKMWGVLQKKTSN LGYSRRALINLSPPSMVVQKPDYLNDFTHEIPNIQTDSY ESMAKTTPTGGLPRDPQELMVDNPLNQLSTLAGQLSSL PPENQNPASPDVVPCPDEKPFMIQQPSTQAVVSAVSASI PQSSSPTSPEPRPSHSQRNYSPVAGPSSEPSAHTSTPSIGN SQPSTPAPALPVQDPQLLHHCQHCDMYFADNILYTIHM GCHGYENPFQCNICGCKCKNKYDFACHFARGQHNQH |

Degradation Compounds

Disclosed herein are, inter alia, degradation compounds that can, e.g., increase the ubiquitination and/or degradation of the fusion proteins including the degradation tag.

In some embodiments, the degradation compound comprises a member of the thalidomide class of compounds. In some embodiments, members of the thalidomide class of compounds include, but are not limited to, lenalidomide (CC-5013), pomalidomide (CC-4047 or ACTIMID), thalidomide, or salts or derivatives thereof. In some embodiments, the degradation compound can be a mixture of one, two, three, or more members of the thalidomide class of compounds. Thalidomide analogs and immunomodulatory properties of thalidomide analogs are described in Bodera and Stankiewicz, Recent Pat Endocr Metab Immune Drug Discov. 2011 September; 5(3):192-6, which is hereby incorporated by reference in its entirety. The structural complex of thalidomide analogs and the E3 ubiquitin is described in Gandhi et al., Br J Haematol. 2014 March; 164(6):811-21, which is hereby incorporated by reference in its entirety. The modulation of the E3 ubiquitin ligase by thalidomide analogs is described in Fischer et al., Nature. 2014 Aug. 7; 512(7512):49-53, which is hereby incorporated by reference in its entirety.

In some embodiments, the degradation compound comprises a compound of Formula (I):

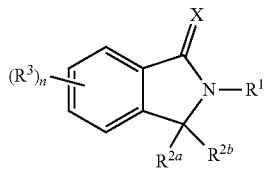

(I)

or a pharmaceutically acceptable salt, ester, hydrate, solvate, or tautomer thereof, wherein:

X is O or S;

$R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached form a carbonyl group or a thiocarbonyl group;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)$_x$N($R^C$)($R^D$), or —N($R^C$)S(O)$_x R^E$, wherein each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)$_x$N($R^C$)($R^D$), —N($R^C$)S(O)$_x R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with one or more $R^8$;

each $R^7$ is independently halo, oxo, cyano, —O$R^B$, —N($R^C$)($R^D$), —C(O)N($R^C$)($R^D$), or —N($R^C$)C(O)$R^A$;

each $R^8$ is independently $C_1$-$C_6$ alkyl, cyano, —O$R^B$, —N($R^C$)($R^D$), —C(O)N($R^C$)($R^D$), or —N($R^C$)C(O)$R^A$;

n is 0, 1, 2, 3 or 4; and x is 0, 1, or 2.

In some embodiments, X is O.

In some embodiments, $R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by 1-12 $R^4$ (e.g., 1 $R^4$, 2 $R^4$, 3 $R^4$, 4 $R^4$, 5 $R^4$, 6 $R^4$, 7 $R^4$, 8 $R^4$, 9 $R^4$, 10 $R^4$, 11 $R^4$, or 12 $R^4$). In some embodiments, $R^1$ is heterocyclyl. In some embodiments, $R^1$ is a 6-membered heterocyclyl or a 5-membered heterocyclyl. In some embodiments, $R^1$ is a 6-membered heterocyclyl or a 5-membered heterocyclyl, each of which is independently and optionally substituted by 1-6 $R^4$ (e.g., 1 $R^4$, 2 $R^4$, 3 $R^4$, 4 $R^4$, 5 $R^4$, or 6 $R^4$). In some embodiments, $R^1$ is a nitrogen-containing heterocyclyl. In some embodiments, $R^1$ is piperidinyl (e.g., piperidine-2,6-dionyl).

In some embodiments, each of $R^{2a}$ and $R^{2b}$ is independently hydrogen. In some embodiments, $R^{2a}$ and $R^{2b}$ together with the carbon to which they are attached form a carbonyl group.

In some embodiments, each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)—N($R^C$)($R^D$), or —N($R^C$)S(O)$_x R^E$, wherein each alkyl, alkenyl, alkynyl, and heteroalkyl is independently and optionally substituted with 1-12 $R^6$ (e.g., 1 $R^6$, 2 $R^6$, 3 $R^6$, 4 $R^6$, 5 $R^6$, 6 $R^6$, 7 $R^6$, 8 $R^6$, 9 $R^6$, 10 $R^6$, 11 $R^6$, or 12 $R^6$). In some embodiments, $R^3$ is $C_1$-$C_6$ heteroalkyl, —N($R^C$)($R^D$) or —N($R^C$)C(O)$R^A$. In some embodiments, $R^3$ is $C_1$-$C_6$ heteroalkyl (e.g., CH$_2$NHC(O)CH$_2$-phenyl-t-butyl), —N($R^C$)($R^D$) (e.g., NH$_2$), or —N($R^C$)C(O)$R^A$ (e.g., NHC(O)CH$_3$). In some embodiments, $R^3$ is $C_1$-$C_6$ heteroalkyl optionally substituted with 1-6 $R^6$ (e.g., 1 $R^6$, 2 $R^6$, 3 $R^6$, 4 $R^6$, 5 $R^6$, or 6 $R^6$).

In some embodiments, each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)—N($R^C$)($R^D$), —N($R^C$)S(O)$_x R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with 1-12 $R^7$ (e.g., 1 $R^7$, 2 $R^7$, 3 $R^7$, 4 $R^7$, 5 $R^7$, 6 $R^7$, 7 $R^7$, 8 $R^7$, 9 $R^7$, 10 $R^7$, 11 $R^7$, or 12 $R^7$).

In some embodiments, each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with 1-6 $R^8$ (e.g., 1 $R^8$, 2 $R^8$, 3 $R^8$, 4 $R^8$, 5 $R^8$, or 6 $R^8$).

In an embodiment, X is O. In an embodiment, $R^1$ is heterocyclyl (e.g., piperidine-2,6-dionyl). In an embodiment, each of $R^{2a}$ and $R^{2b}$ is independently hydrogen. In an embodiment, n is 1. In an embodiment, $R^3$ is —N($R^C$)($R^D$) (e.g., —NH$_2$). In an embodiment, the degradation compound comprises lenalidomide, e.g., 3-(4-amino-1-oxoisoindolin-2-yl)piperidine-2,6-dione, or a pharmaceutically acceptable salt thereof. In an embodiment, the degradation compound is lenalidomide, e.g., according to the following formula:

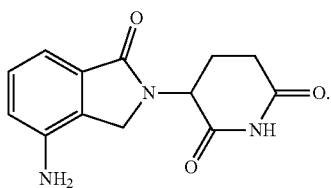 [SMILES: Nc1cccc2c1CN(C1CCC(=O)NC1=O)C2=O]

In an embodiment, X is O. In an embodiment, $R^1$ is heterocyclyl (e.g., piperidinyl-2,6-dionyl). In some embodiments, $R^{2a}$ and $R^{2b}$ together with the carbon to which they are attached form a carbonyl group. In an embodiment, n is 1. In an embodiment, $R^3$ is —N($R^C$)($R^D$) (e.g., —NH$_2$). In an embodiment, the degradation compound comprises pomalidomide, e.g., 4-amino-2-(2,6-dioxopiperidin-3-yl)isoindoline-1,3-dione, or a pharmaceutically acceptable salt thereof. In an embodiment, the degradation compound is pomalidomide, e.g., according to the following formula:

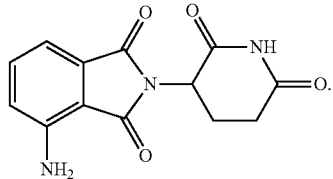 [SMILES: Nc1cccc2c1C(=O)N(C1CCC(=O)NC1=O)C2=O]

In an embodiment, X is O. In an embodiment, $R^1$ is heterocyclyl (e.g., piperidinyl-2,6-dionyl). In an embodiment, $R^{2a}$ and $R^{2b}$ together with the carbon to which they are attached form a carbonyl group. In an embodiment, n is 0. In an embodiment, the degradation compound comprises thalidomide, e.g., 2-(2,6-dioxopiperidin-3-yl)isoindoline-1,3-dione, or a pharmaceutically acceptable salt thereof. In an embodiment, the degradation product is thalidomide, e.g., according to the following formula:

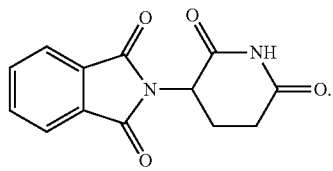 [SMILES: O=C1CCC(N2C(=O)c3ccccc3C2=O)C(=O)N1]

In an embodiment, X is O. In an embodiment, $R^1$ is heterocyclyl (e.g., piperidine-2,6-dionyl). In an embodiment, each of $R^{2a}$ and $R^{2b}$ is independently hydrogen. In an embodiment, n is 1. In an embodiment, $R^3$ is $C_1$-$C_6$ heteroalkyl (e.g., CH$_2$NHC(O)CH$_2$-phenyl-t-butyl). In an embodiment, $R^3$ is $C_1$-$C_6$ heteroalkyl substituted with 1 $R^6$ (e.g., CH$_2$NHC(O)CH$_2$-phenyl-t-butyl). In an embodiment, the degradation compound comprises 2-(4-(tert-butyl)phenyl)-N-((2-(2,6-dioxopiperidin-3-yl)-1-oxoisoindolin-5-yl)methyl)acetamide, or a pharmaceutically acceptable salt thereof. In an embodiment, the degradation compound has the structure as shown in the following formula:

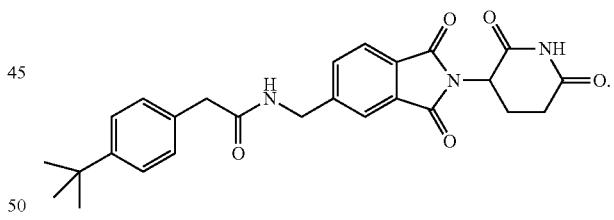

In some embodiments, the degradation compound is a compound of Formula (I-a):

(I-a)

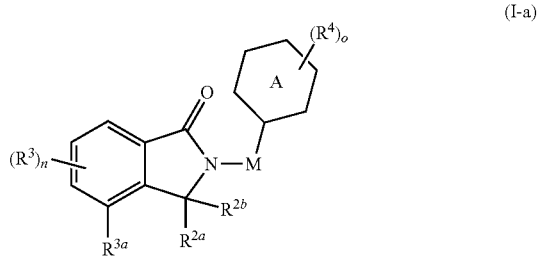

or a pharmaceutically acceptable salt, ester, hydrate, or tautomer thereof, wherein:

Ring A is carbocyclyl, heterocyclyl, aryl, or heteroaryl, each of which is independently and optionally substituted with one or more $R^4$;

M is absent, $C_1$-$C_6$ alkyl, $C_2$-$C_6$ alkenyl, $C_2$-$C_6$ alkynyl, or $C_1$-$C_6$ heteroalkyl, wherein each alkyl, alkenyl, alkynyl, and heteroalkyl is independently and optionally substituted with one or more $R^4$;

each of $R^{2a}$ and $R^{2b}$ is independently hydrogen or $C_1$-$C_6$ alkyl; or $R^{2a}$ and $R^{2b}$ together with the carbon atom to which they are attached to form a carbonyl group or thiocarbonyl group;

$R^{3a}$ is hydrogen, $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)—N($R^C$)($R^D$), or —N($R^C$)S(O)$_x$$R^E$, wherein each alkyl, alkenyl, alkynyl, and heteroalkyl is independently and optionally substituted with one or more $R^6$;

each of $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)$_x$N($R^C$)($R^D$), or —N($R^C$)S(O)$_x$$R^E$, wherein each alkyl, alkenyl, alkynyl, and heteroalkyl is independently and optionally substituted with one or more $R^6$;

each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$)($R^D$), —C(O)N($R^C$)($R^D$), —N($R^C$)C(O)$R^A$, S(O)$_x$$R^E$, —S(O)$_x$N($R^C$)($R^D$), —N($R^C$)S(O)$_x$$R^E$, carbocyclyl, heterocyclyl, aryl, or heteroaryl, wherein each alkyl, alkenyl, alkynyl, carbocyclyl, heterocyclyl, aryl, and heteroaryl is independently and optionally substituted with one or more $R^7$;

each of $R^A$, $R^B$, $R^C$, $R^D$, and $R^E$ is independently hydrogen or $C_1$-$C_6$ alkyl;

each $R^6$ is independently $C_1$-$C_6$ alkyl, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with one or more $R^8$;

each $R^7$ is independently halo, oxo, cyano, —O$R^B$, —N($R^C$)($R^D$), —C(O)N($R^C$)($R^D$), or —N($R^C$)C(O)$R^A$;

each $R^8$ is independently $C_1$-$C_6$ alkyl, cyano, —O$R^B$, —N($R^C$)($R^D$), —C(O)N($R^C$)($R^D$), or —N($R^C$)C(O)$R^A$;

n is 0, 1, 2, or 3;

is 0, 1, 2, 3, 4, or 5; and x is 0, 1, or 2.

In some embodiments, X is O.

In some embodiments, M is $C_1$-$C_6$ alkyl, $C_2$-$C_6$ alkenyl, $C_2$-$C_6$ alkynyl, or $C_1$-$C_6$ heteroalkyl, wherein each alkyl, alkenyl, alkynyl, and heteroalkyl is independently and optionally substituted with 1-6 $R^4$ (e.g., 1 $R^4$, 2 $R^4$, 3 $R^4$, 4 $R^4$, 5 $R^4$, or 6 $R^4$). In some embodiments, M is absent.

In some embodiments, Ring A is carbocyclyl, heterocyclyl, aryl, or heteroaryl, each of which is independently and optionally substituted with 1-6 $R^4$ (e.g., 1 $R^4$, 2 $R^4$, 3 $R^4$, 4 $R^4$, 5 $R^4$, or 6 $R^4$). In some embodiments, Ring A is heterocyclyl. In some embodiments, Ring A is heterocyclyl, e.g., a 6-membered heterocyclyl or a 5-membered heterocyclyl. In some embodiments, Ring A is a nitrogen-containing heterocyclyl. In some embodiments, Ring A is piperidinyl (e.g., piperidine-2,6-dionyl).

In some embodiments, M is absent and Ring A is heterocyclyl (e.g., piperidinyl, e.g., piperidine-2,6-dionyl).

In some embodiments, each of $R^{2a}$ and $R^{2b}$ is independently hydrogen. In some embodiments, $R^{2a}$ and $R^{2b}$ together with the carbon to which they are attached form a carbonyl group.

In some embodiments, $R^{3a}$ is hydrogen, $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)—N($R^C$)($R^D$), or —N($R^C$)S(O)$_x$$R^E$, wherein each alkyl, alkenyl, alkynyl, and heteroalkyl is independently and optionally substituted with 1-12 $R^6$ (e.g., 1 $R^6$, 2 $R^6$, 3 $R^6$, 4 $R^6$, 5 $R^6$, 6 $R^6$, 7 $R^6$, 8 $R^6$, 9 $R^6$, 10 $R^6$, 11 $R^6$, or 12 $R^6$). In some embodiments, $R^{3a}$ is hydrogen, —N($R^C$)($R^D$) or —N($R^C$)C(O)$R^A$. In some embodiments, $R^{3a}$ is hydrogen. In some embodiments, $R^{3a}$ is —N($R^C$)($R^D$) (e.g., —NH$_2$). In some embodiments, $R^{3a}$ is —N($R^C$)C(O)$R^A$ (e.g, NHC(O)CH$_3$).

In some embodiments, each $R^3$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x$$R^E$, —S(O)—N($R^C$)($R^D$), or —N($R^C$)S(O)$_x$$R^E$, wherein each alkyl, alkenyl, alkynyl, and heteroalkyl is independently and optionally substituted with 1-12 $R^6$ (e.g., 1 $R^6$, 2 $R^6$, 3 $R^6$, 4 $R^6$, 5 $R^6$, 6 $R^6$, 7 $R^6$, 8 $R^6$, 9 $R^6$, 10 $R^6$, 11 $R^6$, or 12 $R^6$). In some embodiments, $R^3$ is $C_1$-$C_6$ heteroalkyl (e.g., CH$_2$NHC(O)CH$_2$-phenyl-t-butyl).

In some embodiments, each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, —C(O)$R^A$, —C(O)O$R^B$, —O$R^B$, —N($R^C$) ($R^D$), —C(O)N($R^C$)($R^D$), —N($R^C$)C(O)$R^A$, S(O)$_x$$R^E$, —S(O)—N($R^C$)($R^D$), —N($R^C$)S(O)$_x$$R^E$, carbocyclyl, heterocyclyl, aryl, or heteroaryl, wherein each alkyl, alkenyl, alkynyl, carbocyclyl, heterocyclyl, aryl, and heteroaryl is independently and optionally substituted with 1-12 $R^7$ (e.g., 1 $R^7$, 2 $R^7$, 3 $R^7$, 4 $R^7$, 5 $R^7$, 6 $R^7$, 7 $R^7$, 8 $R^7$, 9 $R^7$, 10 $R^7$, 11 $R^7$, or 12 $R^7$).

In some embodiments, each $R^6$ is independently $C_1$-$C_6$ alkyl, oxo, cyano, —O$R^B$, —N($R^C$)($R^D$), —C(O)N($R^C$) ($R^D$), —N($R^C$)C(O)$R^A$, aryl, or heteroaryl, wherein each aryl and heteroaryl is independently and optionally substituted with 1-6 $R^8$ (e.g., 1 $R^8$, 2 $R^8$, 3 $R^8$, 4 $R^8$, 5 $R^8$, or 6 $R^8$).

In some embodiments, n is 0 or 1. In some embodiments, n is 0. In some embodiments, n is 1.

In some embodiments, the degradation compound is a compound of Formula (III):

(III)

or a pharmaceutically acceptable salt, ester, hydrate, or tautomer thereof, wherein:

$X_1$ is CR$_3$;

------ is optionally a double bond when $X_1$ is CR$_3$ and R$_3$ is absent;

each R$_1$ is independently $C_1$-$C_6$ alkyl, $C_1$-$C_6$ haloalkyl, $C_1$-$C_6$ hydroxyalkyl, or halo, or two R$_1$ together with the carbon atoms to which they are attached form a 5- or 6-membered heterocyclyl ring, or two $R_1$, when on adjacent atoms, together with the atoms to which they are attached form a $C_6$-$C_{10}$ aryl or 5- or 6-membered heteroaryl ring comprising 1 to 3 heteroatoms selected from O, N, and S; $R_2$ is hydrogen, $C_1$-$C_6$ alkyl, —C(O)$C_1$-$C_6$ alkyl, —C(O)(CH$_2$)$_{0-3}$—$C_6$-$C_{10}$ aryl, —C(O)O(CH$_2$)$_{0-3}$—$C_6$-$C_{10}$ aryl, $C_6$-$C_{10}$ aryl, or 5- or 6-membered heteroaryl comprising 1 to 3 heteroatoms selected from O, N, and S, $C_3$-$C_8$ carbocyclyl, or 5- to 7-heterocyclyl comprising 1 to 3 heteroatoms selected from O, N, and S, wherein the alkyl is optionally substituted with one or more $R_4$; and the aryl, heteroaryl, carbocyclyl, and heterocyclyl are optionally substituted with one or more $R_5$, or $R_1$ and $R_2$, when on adjacent atoms, together with the atoms to which they are attached form a 5- or 6-membered heterocyclyl ring;

$R_3$ is hydrogen, or $R_3$ is absent when ------ is a double bond;

each $R_4$ is independently selected from —C(O)O$R_6$, —C(O)N$R_6R_{6'}$, —N$R_6$C(O)$R_{6'}$, halo, —OH, —NH$_2$, cyano, $C_6$-$C_{10}$ aryl, 5- or 6-membered heteroaryl comprising 1 to 4 heteroatoms selected from O, N, and S, $C_3$-$C_8$ carbocyclyl, and 5- to 7-membered heterocyclyl ring comprising 1 to 3 heteroatoms selected from O, N, and S, wherein the aryl, heteroaryl, carbocyclyl, and heterocyclyl are optionally substituted with one or more $R_7$;

each $R_5$ is independently selected from $C_1$-$C_6$ alkyl, $C_2$-$C_6$ alkenyl, $C_2$-$C_6$ alkynyl, $C_1$-$C_6$ alkoxy, $C_1$-$C_6$ haloalkyl, $C_1$-$C_6$ haloalkoxy, $C_1$-$C_6$ hydroxyalkyl, halo, —OH, —NH$_2$, cyano, $C_3$-$C_7$ carbocyclyl, 5- to 7-membered heterocyclyl comprising 1 to 3 heteroatoms selected from O, N, and S, $C_6$-$C_{10}$ aryl, and 5- or 6-membered heteroaryl comprising 1 to 3 heteroatoms selected from O, N, and S, or two $R_5$, when on adjacent atoms, together with the atoms to which they are attached form a $C_6$-$C_{10}$aryl or 5- or 6-membered heteroaryl comprising 1 to 3 heteroatoms selected from O, N, and S, optionally substituted with one or more $R_{10}$, or two $R_5$, when on adjacent atoms, together with the atoms to which they are attached form a $C_5$-$C_7$ carbocyclyl or 5- to 7-membered heterocyclyl comprising 1 to 3 heteroatoms selected from O, N, and S optionally substituted with one or more $R_{10}$;

$R_6$ and $R_{6'}$ are each independently hydrogen, $C_1$-$C_6$ alkyl, or $C_6$-$C_{10}$ aryl;

each $R_7$ is independently selected from $C_1$-$C_6$ alkyl, $C_2$-$C_6$ alkenyl, $C_2$-$C_6$ alkynyl, $C_1$-$C_6$ alkoxy, $C_1$-$C_6$ haloalkyl, $C_1$-$C_6$ haloalkoxy, —C(O)$R_8$, —(CH$_2$)$_{0-3}$C(O)O$R_8$, —C(O)N$R_8R_9$, —N$R_8$C(O)$R_9$, —N$R_8$C(O)O$R_9$, —S(O)$_p$N$R_8R_9$, —S(O)$_p$R$_{12}$, ($C_1$-$C_6$)hydroxyalkyl, halo, —OH, —O(CH$_2$)$_{1-3}$CN, —NH$_2$, cyano, —O(CH$_2$)$_{0-3}$—$C_6$-$C_{10}$ aryl, adamantyl, —O(CH$_2$)$_{0-3}$-5- or 6-membered heteroaryl comprising 1 to 3 heteroatoms selected from O, N, and S, $C_6$-$C_{10}$ aryl, monocyclic or bicyclic 5- to 10-membered heteroaryl comprising 1 to 3 heteroatoms selected from O, N, and S, $C_3$-$C_7$ carbocyclyl, and 5- to 7-membered heterocyclyl comprising 1 to 3 heteroatoms selected from O, N, and S, wherein the alkyl is optionally substituted with one or more $R_{11}$, and the aryl, heteroaryl, and heterocyclyl are optionally substituted with one or more substituents each independently selected from halogen, $C_1$-$C_6$ alkyl, $C_1$-$C_6$ haloalkyl, and $C_1$-$C_6$ alkoxy, or two $R_7$ together with the carbon atom to which they are attached form a =(O), or two $R_7$, when on adjacent atoms, together with the atoms to which they are attached form a $C_6$-$C_{10}$ aryl or 5- or 6-membered heteroaryl comprising 1 to 3 heteroatoms selected from O, N, and S, optionally substituted with one or more $R_{10}$, or two $R_7$ together with the atoms to which they are attached form a $C_5$-$C_7$ carbocyclyl or a 5- to 7-membered heterocyclyl comprising 1 to 3 heteroatoms selected from O, N, and S, optionally substituted with one or more $R_{10}$;

$R_8$ and $R_9$ are each independently hydrogen or $C_1$-$C_6$ alkyl;

each $R_{10}$ is independently selected from $C_1$-$C_6$ alkyl, $C_1$-$C_6$ alkoxy, $C_1$-$C_6$ haloalkyl, $C_1$-$C_6$ haloalkoxy, $C_1$-$C_6$ hydroxyalkyl, halo, —OH, —NH$_2$, and cyano, or two $R_{10}$ together with the carbon atom to which they are attached form a =(O);

each $R_{11}$ is independently selected from cyano, $C_1$-$C_6$ alkoxy, $C_6$-$C_{10}$ aryl, and 5- to 7-membered heterocyclyl comprising 1 to 3 heteroatoms selected from O, N, and S, wherein each aryl and heterocyclyl is optionally substituted with one or more substituents each independently selected from $C_1$-$C_6$ alkyl, $C_1$-$C_6$ alkoxy, $C_1$-$C_6$ haloalkyl, $C_1$-$C_6$ haloalkoxy, $C_1$-$C_6$ hydroxyalkyl, halo, —OH, —NH$_2$, and cyano;

$R_{12}$ is $C_1$-$C_6$ alkyl, $C_1$-$C_6$ haloalkyl, $C_6$-$C_{10}$ aryl, or 5- to 7-membered heterocyclyl comprising 1 to 3 heteroatoms selected from O, N, and S;

$R_x$ is hydrogen or deuterium;

p is 0, 1, or 2;

n is 0, 1, or 2;

y is 1 or 2, wherein n+y≥3; and q is 0, 1, 2, 3, or 4.

In some embodiments, the degradation compound of Formula (III) is a compound of Formula (III-a):

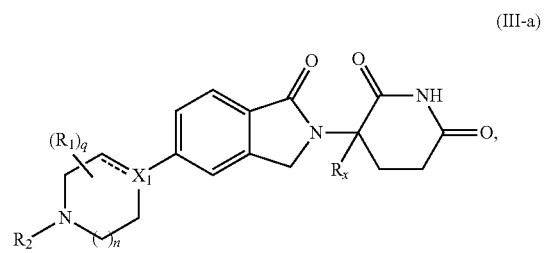

(III-a)

or a pharmaceutically acceptable salt, ester, hydrate, or tautomer thereof, wherein:

$X_1$ is $CR_3$;

------ is optionally a double bond when $X_1$ is $CR_3$ and $R_3$ is absent;

each $R_1$ is independently $C_1$-$C_6$ alkyl, $C_1$-$C_6$ haloalkyl, $C_1$-$C_6$ hydroxyalkyl, or halo;

$R_2$ is hydrogen, $C_1$-$C_6$ alkyl, $C_6$-$C_{10}$ aryl, or 5- or 6-membered heteroaryl comprising 1 to 3 heteroatoms selected from O, N, and S, $C_3$-$C_8$ carbocyclyl, or 5- to 7-membered heterocyclyl comprising 1 to 3 heteroatoms selected from O, N, and S, wherein the alkyl is optionally substituted with one or more $R_4$; and the aryl, heteroaryl, carbocyclyl, and heterocyclyl are optionally substituted with one or more $R_5$;

$R_3$ is hydrogen, or $R_3$ is absent when ----- is a double bond;

each $R_4$ is independently selected from —C(O)OR$_6$, —C(O)NR$_6$R$_{6'}$, —NR$_6$C(O)R$_{6'}$, C$_6$-C$_{10}$ aryl, 5- or 6-membered heteroaryl comprising 1 to 4 heteroatoms selected from O, N, and S, C$_3$-C$_8$ carbocyclyl, and 5- to 7-membered heterocyclyl ring comprising 1 to 3 heteroatoms selected from O, N, and S, wherein the aryl, heteroaryl, carbocyclyl, and heterocyclyl are optionally substituted with one or more $R_7$;

each $R_5$ is independently selected from C$_1$-C$_6$ alkyl, C$_2$-C$_6$ alkenyl, C$_2$-C$_6$ alkynyl, C$_1$-C$_6$ alkoxy, C$_1$-C$_6$ haloalkyl, C$_1$-C$_6$ haloalkoxy, C$_1$-C$_6$ hydroxyalkyl, halo, —OH, —NH$_2$, cyano, C$_3$-C$_7$ carbocyclyl, 5- to 7-membered heterocyclyl comprising 1 to 3 heteroatoms selected from O, N, and S, C$_6$-C$_{10}$ aryl, and 5- or 6-membered heteroaryl comprising 1 to 3 heteroatoms selected from O, N, and S, or two $R_5$, when on adjacent atoms, together with the atoms to which they are attached form a C$_6$-C$_{10}$ aryl or 5- or 6-membered heteroaryl comprising 1 to 3 heteroatoms selected from O, N, and S, optionally substituted with one or more $R_{10}$, or two $R_5$, when on adjacent atoms, together with the atoms to which they are attached form a C$_5$-C$_7$ carbocyclyl or 5- to 7-membered heterocyclyl comprising 1 to 3 heteroatoms selected from O, N, and S optionally substituted with one or more $R_{10}$;

$R_6$ and $R_{6'}$ are each independently hydrogen, or C$_1$-C$_6$ alkyl;

each $R_7$ is independently selected from C$_1$-C$_6$ alkyl, C$_2$-C$_6$ alkenyl, C$_2$-C$_6$ alkynyl, C$_1$-C$_6$ alkoxy, C$_1$-C$_6$ haloalkyl, C$_1$-C$_6$ haloalkoxy, —C(O)R$_8$, —C(O)NR$_8$R$_9$, —NR$_8$C(O)R$_9$, —NR$_8$C(O)OR$_9$, (C$_1$-C$_6$)hydroxyalkyl, halo, —OH, —NH$_2$, cyano, C$_6$-C$_{10}$ aryl, 5- or 6-membered heteroaryl comprising 1 to 3 heteroatoms selected from O, N, and S, C$_3$-C$_7$ carbocyclyl, and 5- to 7-membered heterocyclyl comprising 1 to 3 heteroatoms selected from O, N, and S, or two $R_7$, when on adjacent atoms, together with the atoms to which they are attached form a C$_6$-C$_{10}$ aryl or a 5- or 6-membered heteroaryl comprising 1 to 3 heteroatoms selected from O, N, and S, optionally substituted with one or more $R_{10}$, or two $R_7$ together with the atoms to which they are attached form a C$_5$-C$_7$ carbocyclyl or a 5- to 7-membered heterocyclyl comprising 1 to 3 heteroatoms selected from O, N, and S, optionally substituted with one or more $R_{10}$;

$R_8$ and $R_9$ are each independently hydrogen or C$_1$-C$_6$ alkyl;

each $R_{10}$ is independently selected from C$_1$-C$_6$ alkyl, C$_1$-C$_6$ alkoxy, C$_1$-C$_6$ haloalkyl, C$_1$-C$_6$ haloalkoxy, C$_1$-C$_6$ hydroxyalkyl, halo, —OH, —NH$_2$, and cyano;

$R_x$ is hydrogen or deuterium;

n is 1 or 2; and q is 0, 1, 2, 3, or 4.

In an embodiment, the compound of Formula (III) is a compound of Formula (III-b):

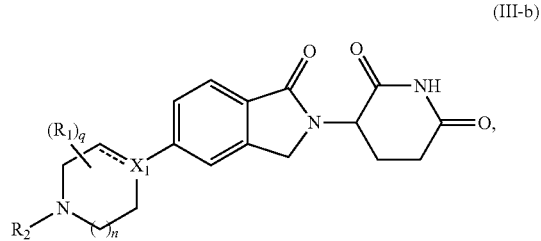

(III-b)

or a pharmaceutically acceptable salt, hydrate, solvate, prodrug, stereoisomer, and tautomer thereof, wherein $X_1$, $R_1$, $R_2$, n, q, and subvariables thereof are defined as described for Formula (III).

In an embodiment, the compound of Formula (III) is a compound of Formula (III-c):

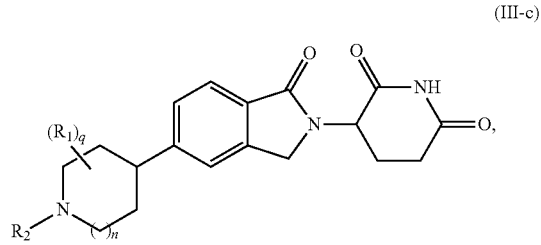

(III-c)

or a pharmaceutically acceptable salt, hydrate, solvate, prodrug, stereoisomer, and tautomer thereof, wherein $R_1$, $R_2$, n, q, and subvariables thereof are defined as described for Formula (III).

In an embodiment, the compound of Formula (III) is a compound of Formula (III-d):

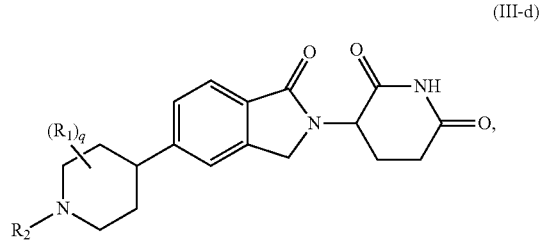

(III-d)

or a pharmaceutically acceptable salt, hydrate, solvate, prodrug, stereoisomer, and tautomer thereof, wherein $R_1$, $R_2$, q, and subvariables thereof are defined as described for Formula (III).

In an embodiment, the compound of Formula (III) is a compound of Formula (III-e):

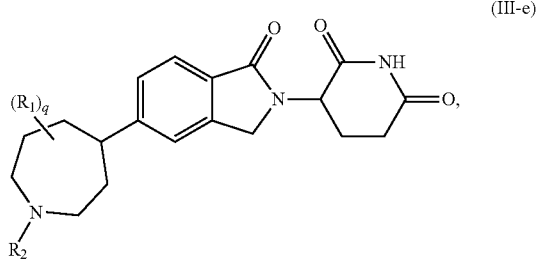

(III-e)

or a pharmaceutically acceptable salt, hydrate, solvate, prodrug, stereoisomer, and tautomer thereof, wherein $R_1$, $R_2$, q, and subvariables thereof are defined as described for Formula (III).

In some embodiments of Formula (III), $X_1$ is CH and n is 1. In another embodiment, $X_1$ is CH, n is 1, and q is 0.

In some embodiments of Formula (III), $X_1$ is CH, n is 1, and q is 0 or 1. In another embodiment, $X_1$ is CH, n is 1, q is 0 or 1, and $R_1$ is $C_1$-$C_6$ alkyl. In another embodiment, $X_1$ is CH, n is 1, q is 0 or 1, $R_1$ is $C_1$-$C_6$ alkyl, and $R_2$ is $C_1$-$C_6$ alkyl optionally substituted with one to three $R_4$. In another embodiment, $X_1$ is CH, n is 1, q is 0 or 1, $R_1$ is $C_1$-$C_6$ alkyl, and $R_2$ is $C_1$-$C_6$ alkyl substituted with one to three $R_4$.

In another embodiment, $X_1$ is CH, n is 1, q is 0, and $R_2$ is $C_1$-$C_6$ alkyl optionally substituted with one to three $R_4$. In another embodiment, $X_1$ is CH, n is 1, q is 0, and $R_2$ is $C_1$-$C_6$ alkyl substituted with one to three $R_4$.

In some embodiments of the formulae above, $X_1$ is CH, n is 1, q is 0 or 1, $R_1$ is $C_1$-$C_6$ alkyl, $R_2$ is $C_1$-$C_6$ alkyl optionally substituted with one to three $R_4$, and each $R_4$ is independently selected from —C(O)OR$_6$, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl are optionally substituted with one to three $R_7$.

In some embodiments of Formula (III), $X_1$ is CH, n is 1, q is 0 or 1, $R_1$ is $C_1$-$C_6$ alkyl, $R_2$ is $C_1$-$C_6$ alkyl substituted with one to three $R_4$, and each $R_4$ is independently selected from —C(O)OR$_6$, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0 or 1, $R_1$ is $C_1$-$C_6$ alkyl, $R_2$ is $C_1$-$C_6$ alkyl optionally substituted with one to three $R_4$, and each $R_4$ is independently selected from $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0 or 1, $R_1$ is $C_1$-$C_6$ alkyl, $R_2$ is $C_1$-$C_6$ alkyl substituted with one to three $R_4$, and each $R_4$ is independently selected from $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0, and $R_2$ is $C_6$-$C_{10}$ aryl, $C_3$-$C_8$ carbocyclyl, or 5- to 7-membered heterocyclyl comprising 1 to 3 heteroatoms selected from O, N, and S, wherein the aryl, carbocyclyl, and heterocyclyl are optionally substituted with one to three $R_5$. In yet another embodiment, $X_1$ is CH, n is 1, q is 0, and $R_2$ is $C_6$-$C_{10}$ aryl, $C_3$-$C_8$ carbocyclyl, or 5- to 7-membered heterocyclyl comprising 1 to 3 heteroatoms selected from O, N, and S.

In some embodiments of Formula (III), $X_1$ is CH, n is 1, q is 0, and $R_2$ is $C_6$-$C_{10}$ aryl optionally substituted with one to three $R_5$. In another embodiment, $X_1$ is CH, n is 1, q is 0, and $R_2$ is 5- or 6-membered heteroaryl comprising 1 to 3 heteroatoms selected from O, N, and S optionally substituted with one to three $R_5$. In yet another embodiment, $X_1$ is CH, n is 1, q is 0, and $R_2$ is $C_3$-$C_8$ carbocyclyl optionally substituted with one to three $R_5$. In another embodiment, $X_1$ is CH, n is 1, q is 0, and $R_2$ is 5- to 7-membered heterocyclyl comprising 1 to 3 heteroatoms selected from O, N, and S, optionally substituted with one to three $R_5$.

In some embodiments of Formula (III), $X_1$ is CH, n is 1, q is 0 or 1, $R_1$ is $C_1$-$C_6$ alkyl, and $R_2$ is $C_6$-$C_{10}$ aryl, $C_3$-$C_8$ carbocyclyl, or 5- to 7-membered heterocyclyl comprising 1 to 3 heteroatoms selected from O, N, and S, wherein the aryl, carbocyclyl, and heterocyclyl are optionally substituted with one to three $R_5$. In yet another embodiment, $X_1$ is CH, n is 1, q is 0 or 1, $R_1$ is $C_1$-$C_6$ alkyl, and $R_2$ is $C_6$-$C_{10}$ aryl, $C_3$-$C_8$ carbocyclyl, or 5- to 7-membered heterocyclyl comprising 1 to 3 heteroatoms selected from O, N, and S.

In some embodiments of Formula (III), $X_1$ is CH, n is 1, q is 0 or 1, $R_1$ is $C_1$-$C_6$ alkyl, and $R_2$ is $C_6$-$C_{10}$ aryl optionally substituted with one to three $R_5$. In another embodiment, $X_1$ is CH, n is 1, q is 0, and $R_2$ is 5- or 6-membered heteroaryl comprising 1 to 3 heteroatoms selected from O, N, and S optionally substituted with one to three $R_5$. In yet another embodiment, $X_1$ is CH, n is 1, q is 0 or 1, $R_1$ is $C_1$-$C_6$ alkyl, and $R_2$ is $C_3$-$C_8$ carbocyclyl optionally substituted with one to three $R_5$. In another embodiment, $X_1$ is CH, n is 1, q is 0 or 1, $R_1$ is $C_1$-$C_6$ alkyl, and $R_2$ is 5- to 7-membered heterocyclyl comprising 1 to 3 heteroatoms selected from O, N, and S, optionally substituted with one to three $R_5$.

In some embodiments of Formula (III), $X_1$ is CH, n is 1, q is 0, and $R_2$ is $C_1$-$C_6$ alkyl optionally substituted with one to three $R_4$. In another embodiment $X_1$ is CH, n is 1, q is 0, and $R_2$ is $C_1$-$C_6$ alkyl substituted with one to three $R_4$.

In some embodiments of Formula (III), $X_1$ is CH, n is 1, q is 0, $R_2$ is $C_1$-$C_6$ alkyl optionally substituted with one to three $R_4$, and each $R_4$ is independently selected from —C(O)OR$_6$, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl substituted with one to three $R_4$, and each $R_4$ is independently selected from —C(O)OR$_6$, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl optionally substituted with one to three $R_4$, and each $R_4$ is independently selected from halo, —OH, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl substituted with one to three $R_4$, and each $R_4$ is independently selected from halo, —OH, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of the formulae above, $X_1$ is CH, n is 1, n1 is 1, q is 0, $R_2$ is $C_1$-$C_6$ alkyl optionally substituted with one to three $R_4$, and each $R_4$ is independently selected from halo, —OH, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, n1 is 1, q is 0, $R_2$ is $C_1$-$C_6$ alkyl substituted with one to three $R_4$, and each $R_4$ is independently selected from halo, —OH, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl optionally substituted with one to three $R_4$, and each $R_4$ is independently selected from $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl substituted with one to three $R_4$, and each $R_4$ is independently selected from $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl optionally substituted with one to three $R_4$, and each $R_4$ is independently selected from halo, —OH, phenyl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl substituted with one to three $R_4$, and each $R_4$ is independently selected from halo, —OH, phenyl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, n1 is 1, q is 0, $R_2$ is $C_1$-$C_6$ alkyl optionally substituted with one to three $R_4$, and each $R_4$ is independently selected from halo, —OH, phenyl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 1, n1 is 1, q is 0, $R_2$ is $C_1$-$C_6$ alkyl substituted with one to three $R_4$, and each $R_4$ is independently selected from halo, —OH, phenyl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the phenyl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl optionally substituted with one to three $R_4$, and each $R_4$ is independently selected from phenyl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the phenyl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl substituted with one to three $R_4$, and each $R_4$ is independently selected from phenyl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the phenyl, heteroaryl, carbocyclyl, and heterocyclyl groups are optionally substituted with one to three $R_7$.

In some embodiments of Formula (III), $X_1$ is CH, n is 1, n1 is 1, q is 0, $R_2$ is $C_1$-$C_6$ alkyl optionally substituted with one to three $R_4$, and each $R_4$ is independently selected from phenyl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the phenyl, heteroaryl, carbocyclyl, and heterocyclyl groups are optionally substituted with one to three $R_7$.

In some embodiments of Formula (III), $X_1$ is CH, n is 1, n1 is 1, q is 0, $R_2$ is $C_1$-$C_6$ alkyl substituted with one to three $R_4$, and each $R_4$ is independently selected from phenyl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the phenyl, heteroaryl, carbocyclyl, and heterocyclyl groups are optionally substituted with one to three $R_7$.

In some embodiments of Formula (III), $X_1$ is CH, n is 1, q is 0, $R_2$ is $C_1$-$C_6$ alkyl optionally substituted with one to three $R_4$, and each $R_4$ is independently selected from phenyl and 5- or 6-membered heteroaryl comprising 1 to 3 heteroatoms selected from O, N, and S, wherein the phenyl and heteroaryl groups are optionally substituted with one to three $R_7$.

In some embodiments of Formula (III), $X_1$ is CH, n is 1, q is 0, $R_2$ is $C_1$-$C_6$ alkyl substituted with one to three $R_4$, and each $R_4$ is independently selected from phenyl and 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the phenyl and heteroaryl groups are optionally substituted with one to three $R_7$.

In some embodiments of Formula (III), $X_1$ is CH, n is 1, n1 is 1, q is 0, $R_2$ is $C_1$-$C_6$ alkyl optionally substituted with one to three $R_4$, and each $R_4$ is independently selected from phenyl and 5- or 6-membered heteroaryl comprising 1 to 3 heteroatoms selected from O, N, and S, wherein the phenyl and heteroaryl groups are optionally substituted with one to three $R_7$.

In some embodiments of Formula (III), $X_1$ is CH, n is 1, n1 is 1, q is 0, $R_2$ is $C_1$-$C_6$ alkyl substituted with one to three $R_4$, and each $R_4$ is independently selected from phenyl and 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the phenyl and heteroaryl groups are optionally substituted with one to three $R_7$.

In some embodiments of Formula (III), $X_1$ is CH, n is 1, q is 0, $R_2$ is $C_1$-$C_6$ alkyl optionally substituted with one to three $R_4$, and each $R_4$ is phenyl optionally substituted with one to three $R_7$.

In some embodiments of Formula (III), $X_1$ is CH, n is 1, q is 0, $R_2$ is $C_1$-$C_6$ alkyl substituted with one to three $R_4$, and each $R_4$ is phenyl optionally substituted with one to three $R_7$.

In some embodiments of Formula (III), $X_1$ is CH, n is 1, n1 is 1, q is 0, $R_2$ is $C_1$-$C_6$ alkyl optionally substituted with one to three $R_4$, and each $R_4$ is phenyl optionally substituted with one to three $R_7$.

In some embodiments of Formula (III), $X_1$ is CH, n is 1, n1 is 1, q is 0, $R_2$ is $C_1$-$C_6$ alkyl substituted with one to three $R_4$, and each $R_4$ is phenyl optionally substituted with one to three $R_7$.

In some embodiments of Formula (III), $X_1$ is CH and n is 2. In another embodiment, $X_1$ is CH, n is 2, and q is 0. In yet another embodiment, $X_1$ is CH, n is 2, and q is 0 or 1. In another embodiment, $X_1$ is CH, n is 2, q is 0 or 1, and $R_1$ is $C_1$-$C_6$ alkyl.

In some embodiments of Formula (III), $X_1$ is CH, n is 2, q is 0 or 1, $R_1$ is $C_1$-$C_6$ alkyl, and $R_2$ is $C_1$-$C_6$ alkyl optionally substituted with one to three $R_4$. In another embodiment, $X_1$ is CH, n is 2, q is 0 or 1, $R_1$ is $C_1$-$C_6$ alkyl, and $R_2$ is $C_1$-$C_6$ alkyl substituted with one to three $R_4$.

In some embodiments of Formula (III), $X_1$ is CH, n is 2, q is 0, and $R_2$ is $C_1$-$C_6$ alkyl optionally substituted with one to three $R_4$. In another embodiment, $X_1$ is CH, n is 2, q is 0, and $R_2$ is $C_1$-$C_6$ alkyl substituted with one to three $R_4$.

In some embodiments of Formula (III), $X_1$ is CH, n is 2, q is 0 or 1, $R_1$ is $C_1$-$C_6$ alkyl, $R_2$ is $C_1$-$C_6$ alkyl optionally substituted with one to three $R_4$, and each $R_4$ is independently selected from —C(O)OR$_6$, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 2, q is 0 or 1, $R_1$ is $C_1$-$C_6$ alkyl, $R_2$ is $C_1$-$C_6$ alkyl substituted with one to three $R_4$, and each $R_4$ is independently selected from —C(O)OR$_6$, $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 2, q is 0 or 1, $R_1$ is $C_1$-$C_6$ alkyl, $R_2$ is $C_1$-$C_6$ alkyl optionally substituted with one to three $R_4$, and each $R_4$ is independently selected from $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 2, q is 0 or 1, $R_1$ is $C_1$-$C_6$ alkyl, $R_2$ is $C_1$-$C_6$ alkyl substituted with one to three $R_4$, and each $R_4$ is independently selected from $C_6$-$C_{10}$ aryl, 5- or 6-membered heteroaryl comprising 1 to 3 heteroatoms selected from O, N, and S, $C_3$-$C_8$ carbocyclyl, and 5- to 7-membered heterocyclyl comprising 1 to 3 heteroatoms selected from O, N, and S, wherein the aryl, heteroaryl, carbocyclyl, and heterocyclyl groups are optionally substituted with one to three $R_7$.

In some embodiments of Formula (III), $X_1$ is CH, n is 2, q is 0, and $R_2$ is $C_6$-$C_{10}$ aryl, $C_3$-$C_8$ carbocyclyl, or 5- to 7-membered heterocyclyl comprising 1 to 3 heteroatoms selected from O, N, and S, wherein the aryl, carbocyclyl, and heterocyclyl are optionally substituted with one to three $R_5$. In yet another embodiment, $X_1$ is CH, n is 2, q is 0, and $R_2$ is $C_6$-$C_{10}$ aryl, $C_3$-$C_8$ carbocyclyl, or 5- to 7-membered heterocyclyl comprising 1 to 3 heteroatoms selected from O, N, and S.

In some embodiments of Formula (III), $X_1$ is CH, n is 2, q is 0, and $R_2$ is $C_6$-$C_{10}$ aryl optionally substituted with one to three $R_5$. In another embodiment, $X_1$ is CH, n is 2, q is 0, and $R_2$ is 5- or 6-membered heteroaryl comprising 1 to 3 heteroatoms selected from O, N, and S optionally substituted with one to three $R_5$. In yet another embodiment, $X_1$ is CH, n is 2, q is 0, and $R_2$ is $C_3$-$C_8$ carbocyclyl optionally substituted with one to three $R_5$. In another embodiment, $X_1$ is CH, n is 2, q is 0, and $R_2$ is 5- to 7-membered heterocyclyl comprising 1 to 3 heteroatoms selected from O, N, and S, optionally substituted with one to three $R_5$.

In some embodiments of Formula (III), $X_1$ is CH, n is 2, q is 0 or 1, $R_1$ is $C_1$-$C_6$ alkyl, and $R_2$ is $C_6$-$C_{10}$ aryl, $C_3$-$C_8$ carbocyclyl, or 5- to 7-membered heterocyclyl comprising 1 to 3 heteroatoms selected from O, N, and S, wherein the aryl, carbocyclyl, and heterocyclyl are optionally substituted with one to three $R_5$. In yet another embodiment, $X_1$ is CH, n is 2, q is 0 or 1, $R_1$ is $C_1$-$C_6$ alkyl, and $R_2$ is $C_6$-$C_{10}$ aryl, $C_3$-$C_8$ carbocyclyl, or 5- to 7-membered heterocyclyl comprising 1 to 3 heteroatoms selected from O, N, and S.

In some embodiments of Formula (III), $X_1$ is CH, n is 2, q is 0 or 1, $R_1$ is $C_1$-$C_6$ alkyl, and $R_2$ is $C_6$-$C_{10}$ aryl optionally substituted with one to three $R_5$. In another embodiment, $X_1$ is CH, n is 2, q is 0, and $R_2$ is 5- or 6-membered heteroaryl comprising 1 to 3 heteroatoms selected from O, N, and S optionally substituted with one to three $R_5$. In yet another embodiment, $X_1$ is CH, n is 2, q is 0 or 1, $R_1$ is $C_1$-$C_6$ alkyl, and $R_2$ is $C_3$-$C_8$ carbocyclyl optionally substituted with one to three $R_5$. In another embodiment, $X_1$ is CH, n is 2, q is 0 or 1, $R_1$ is $C_1$-$C_6$ alkyl, and $R_2$ is 5- to 7-membered heterocyclyl comprising 1 to 3 heteroatoms selected from O, N, and S, optionally substituted with one to three $R_5$.

In some embodiments of Formula (III),
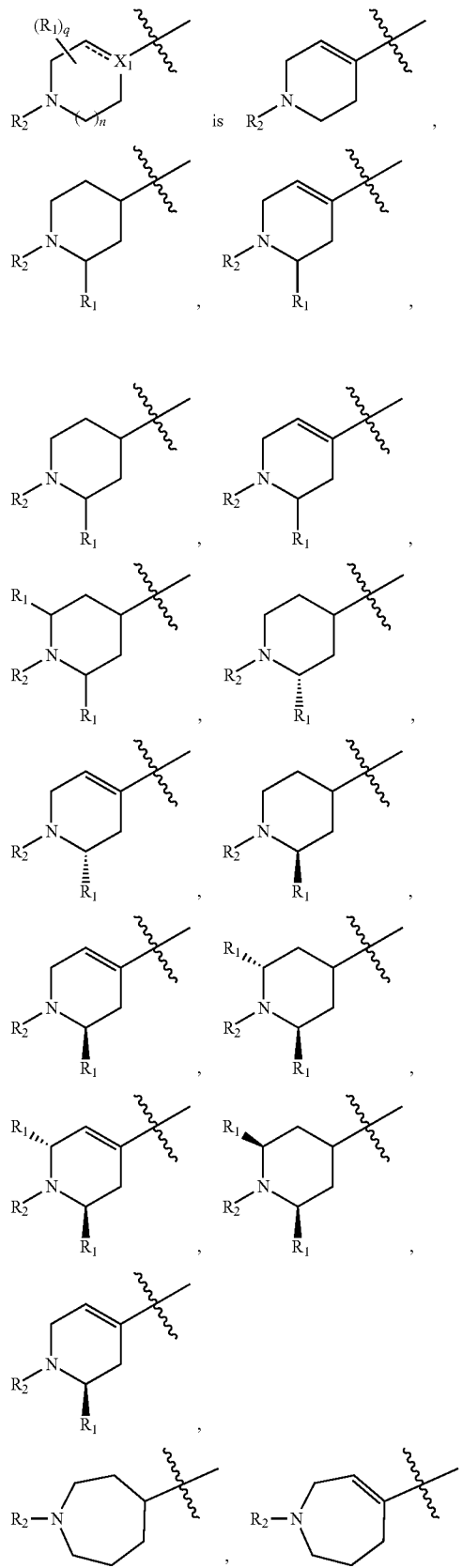
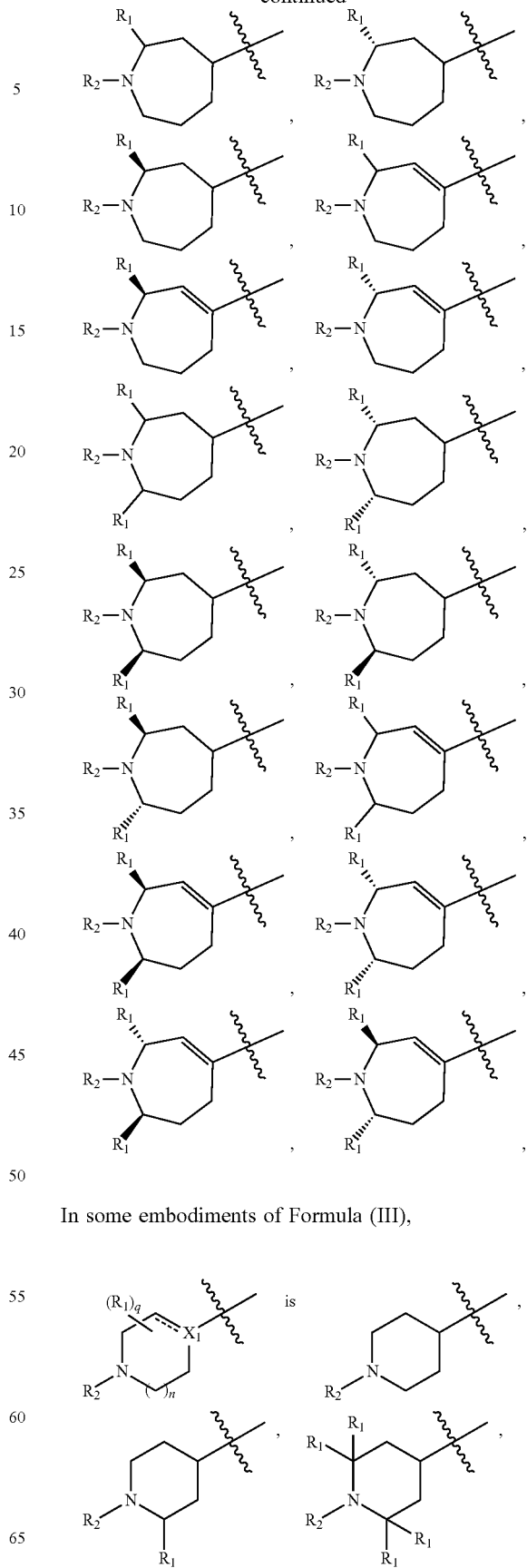
In some embodiments of Formula (III),
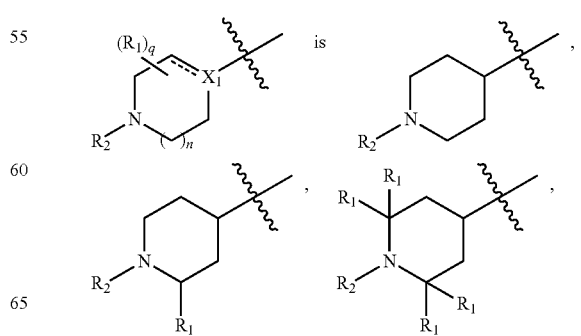

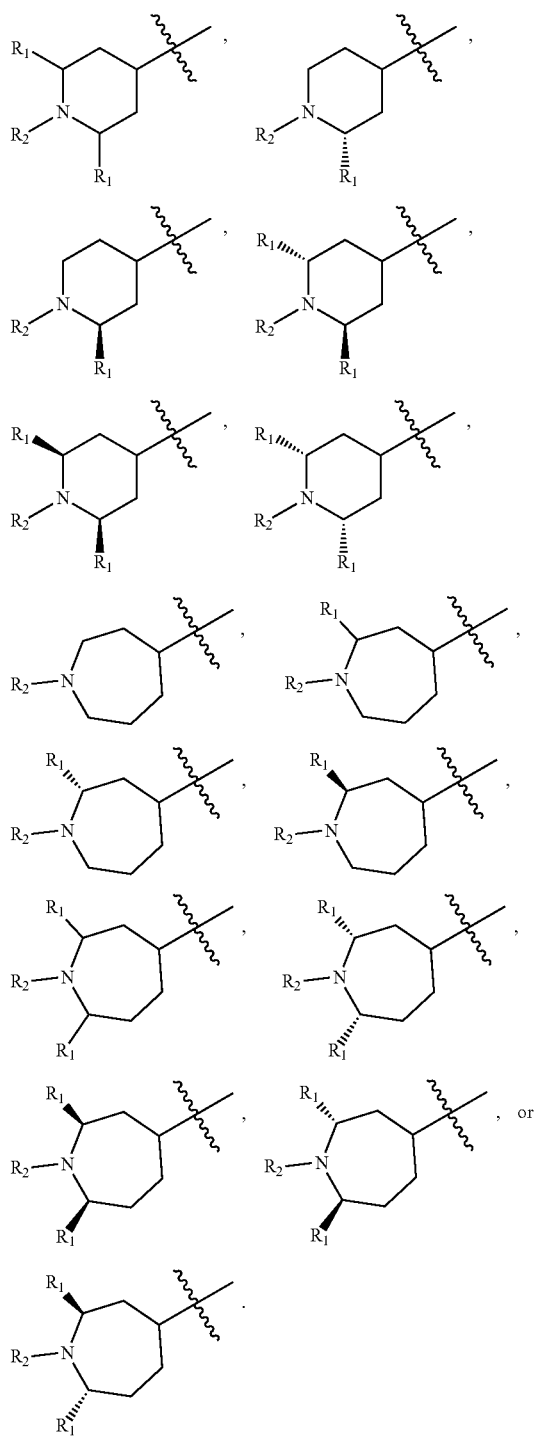

In some embodiments of Formula (III),

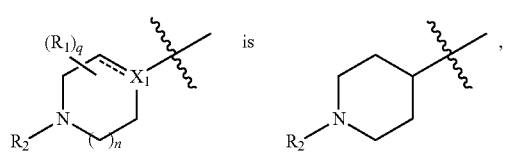 is 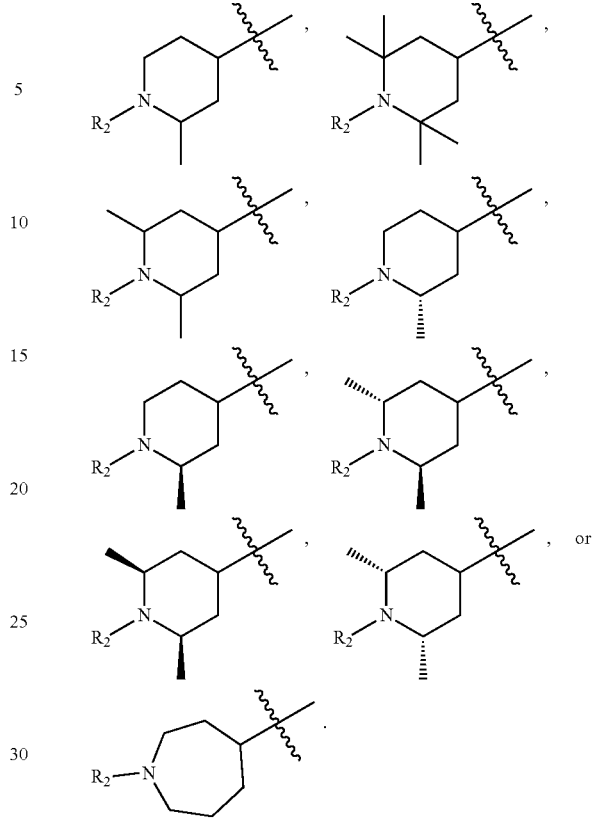,

A degradation compound may comprise one or more chiral centers or exist as one or more stereoisomers. In some embodiments, the degradation compound comprises a single chiral center and is a mixture of stereoisomers, e.g., an R stereoisomer and an S stereoisomer. In some embodiments, the mixture comprises a ratio of R stereoisomers to S stereoisomers, for example, about a 1:1 ratio of R stereoisomers to S stereoisomers (i.e., a racemic mixture). In some embodiments, the mixture comprises a ratio of R stereoisomers to S stereoisomers of about 51:49, about 52:48, about 53:47, about 54:46, about 55:45, about 60:40, about 65:35, about 70:30, about 75:25, about 80:20, about 85:15, about 90:10, about 95:5, or about 99:1. In some embodiments, the mixture comprises a ratio of S stereoisomers to R stereoisomers of about 51:49, about 52:48, about 53:47, about 54:46, about 55:45, about 60:40, about 65:35, about 70:30, about 75:25, about 80:20, about 85:15, about 90:10, about 95:5, or about 99:1. In some embodiments, the degradation compound is a single stereoisomer of Formula (I) or Formula (I-a), e.g., a single R stereoisomer or a single S stereoisomer.

In some embodiments, the degradation compound (e.g., a compound of Formulas (I), (I-a), (III), (III-a), (III-b), (III-c), (III-d), or (III-e)) is not attached to a linker or attachment group. In some embodiments, the degradation compound (e.g., a compound of Formulas (I), (I-a), (III), (III-a), (III-b), (III-c), (III-d), or (III-e)) does not comprise another moiety, e.g., a ligand, a targeting agent, or a moiety capable of dimerization.

In an embodiment, the degradation compound is a compound of Formula (I) or a pharmaceutically acceptable salt thereof. In an embodiment, the degradation compound is a compound of Formula (I-a) or a pharmaceutically acceptable salt thereof. In an embodiment, the degradation compound is a compound of Formula (III) or a pharmaceutically acceptable salt thereof. In an embodiment, the degradation compound is a compound of Formula (III-a) or a pharmaceutically acceptable salt thereof. In an embodiment, the degradation compound is a compound of Formula (III-b) or a pharmaceutically acceptable salt thereof. In an embodiment, the degradation compound is a compound of Formula (III-c) or a pharmaceutically acceptable salt thereof. In an embodiment, the degradation compound is a compound of Formula (III-d) or a pharmaceutically acceptable salt thereof. In an embodiment, the degradation compound is a compound of Formula (III-e) or a pharmaceutically acceptable salt thereof.

Exemplary degradation compounds of the disclosure (e.g., a compound of Formula (III), (III-a), (III-b), (III-c), (III-d), or (III-e) or a pharmaceutically acceptable salt thereof) include those in Table 29.

TABLE 29

Exemplary degradation compounds

| Cmpd No. | Structure | Compound Name |
|---|---|---|
| I-1 | 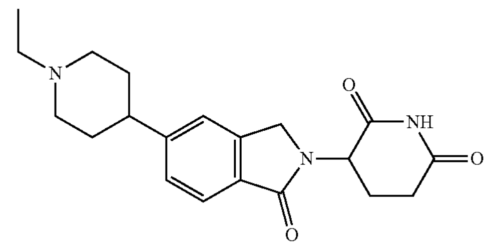 [SMILES: CCN1CCC(c2ccc3c(c2)CN(C2CCC(=O)NC2=O)C3=O)CC1] | 3-(5-(1-ethylpiperidin-4-yl)-1-oxoisoindolin-2-yl)piperidine-2,6-dione |
| I-2 | 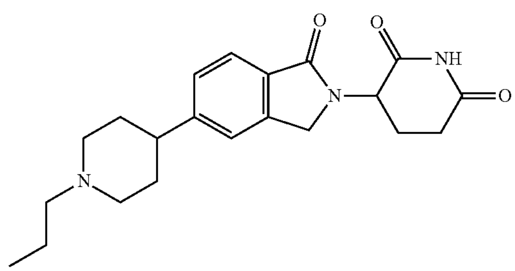 [SMILES: CCCN1CCC(c2ccc3c(c2)CN(C2CCC(=O)NC2=O)C3=O)CC1] | 3-(1-oxo-5-(1-propyl-piperidin-4-yl) isoindolin-2-yl) piperidine-2,6-dione |
| I-3 | 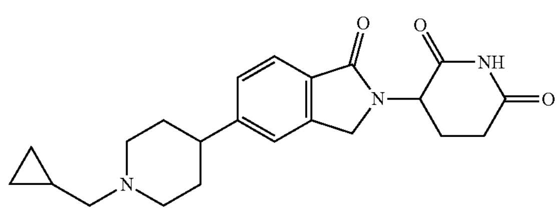 [SMILES: O=C1CCC(N2Cc3cc(C4CCN(CC5CC5)CC4)ccc3C2=O)C(=O)N1] | 3-(5-(1-(cyclopropylmethyl) piperidin-4-yl)-1-oxoisoindolin-2-yl) piperidine-2,6-dione |
| I-4 | 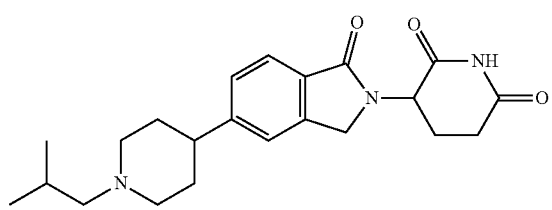 [SMILES: CC(C)CN1CCC(c2ccc3c(c2)CN(C2CCC(=O)NC2=O)C3=O)CC1] | 3-(5-(1-isobutyl-piperidin-4-yl)-1-oxoisoindolin-2-yl) piperidine-2,6-dione |
| I-5 | 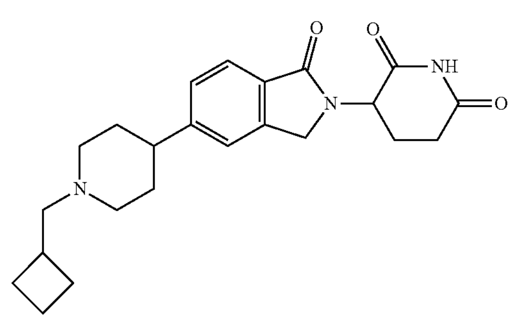 [SMILES: O=C1CCC(N2Cc3cc(C4CCN(CC5CCC5)CC4)ccc3C2=O)C(=O)N1] | 3-(5-(1-(cyclobutylmethyl) piperidin-4-yl)-1-oxoisoindolin-2-yl) piperidine-2,6-dione |

TABLE 29-continued

Exemplary degradation compounds

| Cmpd No. | Structure | Compound Name |
|---|---|---|
| I-6 | 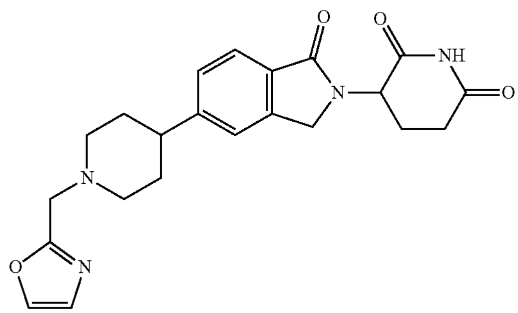 [SMILES: O=C1CCC(N2Cc3cc(C4CCN(Cc5ncco5)CC4)ccc3C2=O)C(=O)N1] | 3-(5-(1-(oxazol-2-ylmethyl)piperidin-4-yl)-1-oxoisoindolin-2-yl)piperidine-2,6-dione |
| I-7 | 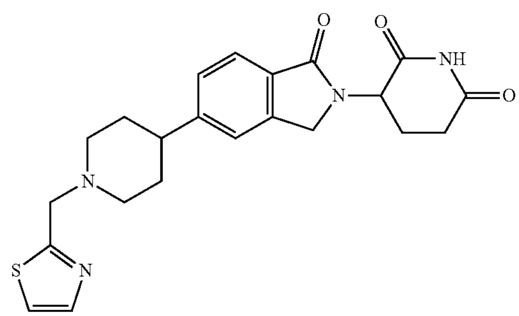 [SMILES: O=C1CCC(N2Cc3cc(C4CCN(Cc5nccs5)CC4)ccc3C2=O)C(=O)N1] | 3-(1-oxo-5-(1-(thiazol-2-ylmethyl)piperidin-4-yl)isoindolin-2-yl)piperidine-2,6-dione |
| I-8 | 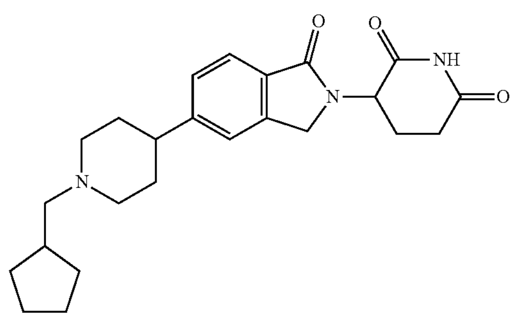 [SMILES: O=C1CCC(N2Cc3cc(C4CCN(CC5CCCC5)CC4)ccc3C2=O)C(=O)N1] | 3-(5-(1-(cyclopentylmethyl)piperidin-4-yl)-1-oxoisoindolin-2-yl)piperidine-2,6-dione |
| I-9 | 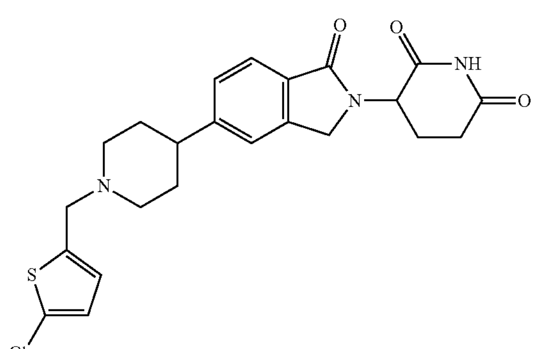 | 3-(5-(1-((5-chlorothiophen-2-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-10 | 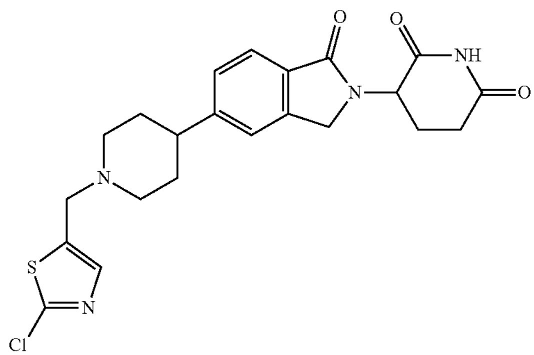 [SMILES: O=C1CCC(N2Cc3cc(C4CCN(Cc5ccc(Cl)s5)CC4)ccc3C2=O)C(=O)N1] | 3-(5-(1-((2-chloro-thiazol-5-yl)methyl)piperidin-4-yl)-1-oxoisoindolin-2-yl)piperidine-2,6-dione |
| I-11 | 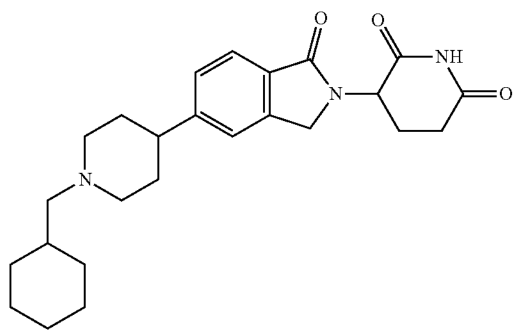 [SMILES: O=C1CCC(N2Cc3cc(C4CCN(CC5CCCCC5)CC4)ccc3C2=O)C(=O)N1] | 3-(5-(1-(cyclohexylmethyl)piperidin-4-yl)-1-oxoisoindolin-2-yl)piperidine-2,6-dione |
| I-12 | 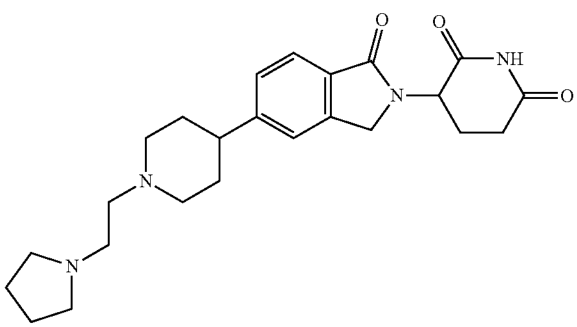 [SMILES: O=C1CCC(N2Cc3cc(C4CCN(CCN5CCCC5)CC4)ccc3C2=O)C(=O)N1] | 3-(1-oxo-5-(1-(2-(pyrrolidin-1-yl)ethyl)piperidin-4-yl)isoindolin-2-yl)piperidine-2,6-dione |
| I-13 | 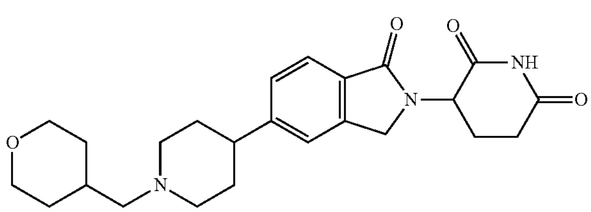 [SMILES: O=C1CCC(N2Cc3cc(C4CCN(CC5CCOCC5)CC4)ccc3C2=O)C(=O)N1] | 3-(1-oxo-5-(1-((tetrahydro-2H-pyran-4-yl)methyl)piperidin-4-yl)isoindolin-2-yl)piperidine-2,6-dione |
| I-14 | 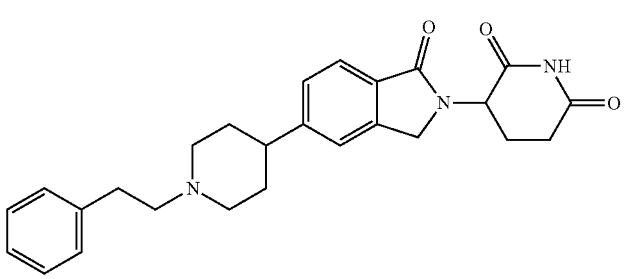 [SMILES: O=C1CCC(N2Cc3cc(C4CCN(CCc5ccccc5)CC4)ccc3C2=O)C(=O)N1] | 3-(1-oxo-5-(1-phenethylpiperidin-4-yl)isoindolin-2-yl)piperidine-2,6-dione |

TABLE 29-continued

Exemplary degradation compounds

| Cmpd No. | Structure | Compound Name |
|---|---|---|
| I-15 | 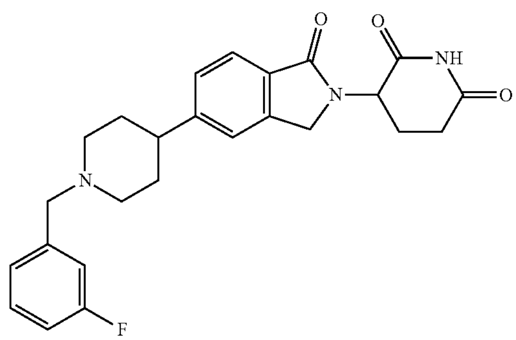 | 3-(5-(1-(3-fluorobenzyl)piperidin-4-yl)-1-oxoisoindolin-2-yl)piperidine-2,6-dione |
| I-16 | 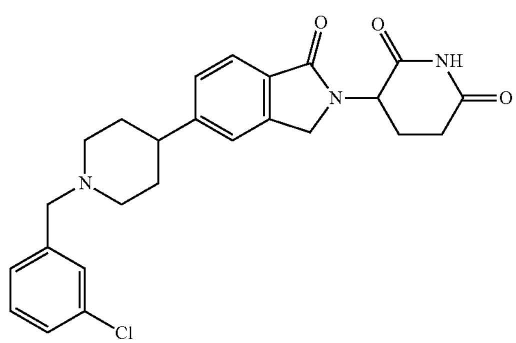 [SMILES: O=C1CCC(N2Cc3cc(C4CCN(Cc5cccc(F)c5)CC4)ccc3C2=O)C(=O)N1] | 3-(5-(1-(3-chlorobenzyl)piperidin-4-yl)-1-oxoisoindolin-2-yl)piperidine-2,6-dione |
| I-17 | 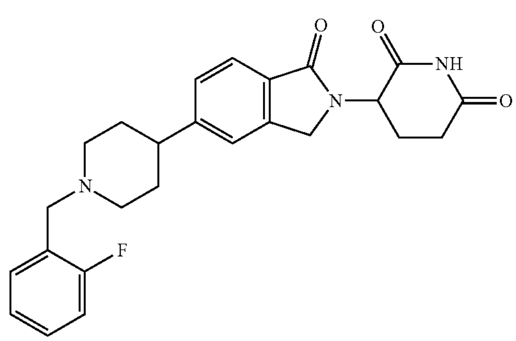 [SMILES: O=C1CCC(N2Cc3cc(C4CCN(Cc5ccccc5F)CC4)ccc3C2=O)C(=O)N1] | 3-(5-(1-(2-fluorobenzyl)piperidin-4-yl)-1-oxoisoindolin-2-yl)piperidine-2,6-dione |
| I-18 | 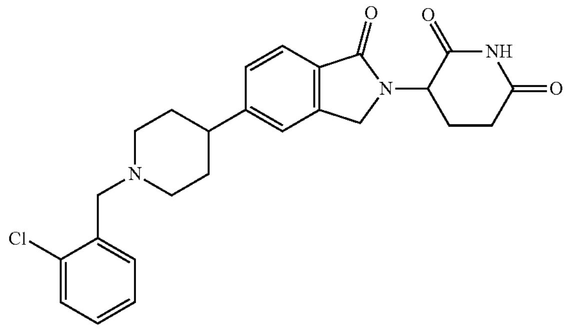 [SMILES: O=C1CCC(N2Cc3cc(C4CCN(Cc5ccccc5Cl)CC4)ccc3C2=O)C(=O)N1] | 3-(5-(1-(2-chlorobenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-19 | 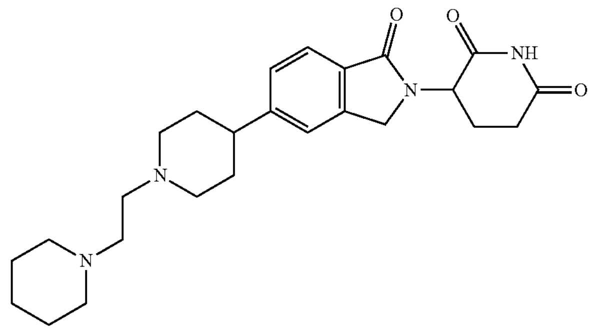 [SMILES: O=C1CCC(N2Cc3cc(C4CCN(CCN5CCCCC5)CC4)ccc3C2=O)C(=O)N1] | 3-(1-oxo-5-(1-(2-(piperidin-1-yl)ethyl)piperidin-4-yl)isoindolin-2-yl)piperidine-2,6-dione |
| I-20 | 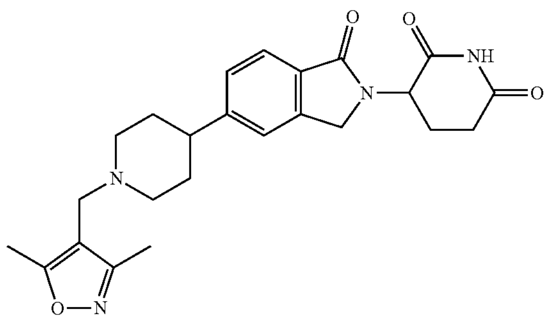 [SMILES: Cc1noc(C)c1CN1CCC(c2ccc3c(c2)CN(C2CCC(=O)NC2=O)C3=O)CC1] | 3-(5-(1-((3,5-dimethylisoxazol-4-yl)methyl)piperidin-4-yl)-1-oxoisoindolin-2-yl)piperidine-2,6-dione |
| I-21 | 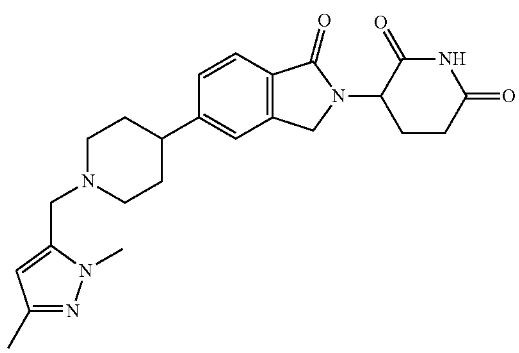 [SMILES: Cc1cc(CN2CCC(c3ccc4c(c3)CN(C3CCC(=O)NC3=O)C4=O)CC2)n(C)n1] | 3-(5-(1-((1,3-dimethyl-1H-pyrazol-5-yl)methyl)piperidin-4-yl)-1-oxoisoindolin-2-yl)piperidine-2,6-dione |
| I-22 | 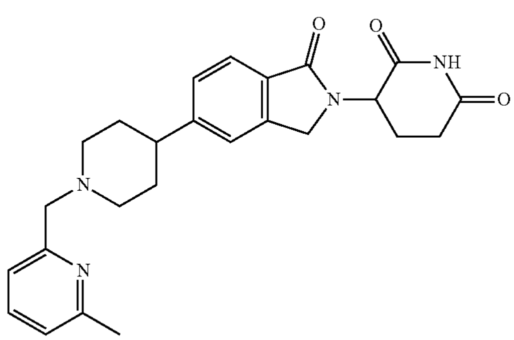 [SMILES: Cc1cccc(CN2CCC(c3ccc4c(c3)CN(C3CCC(=O)NC3=O)C4=O)CC2)n1] | 3-(5-(1-((6-methylpyridin-2-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-23 | 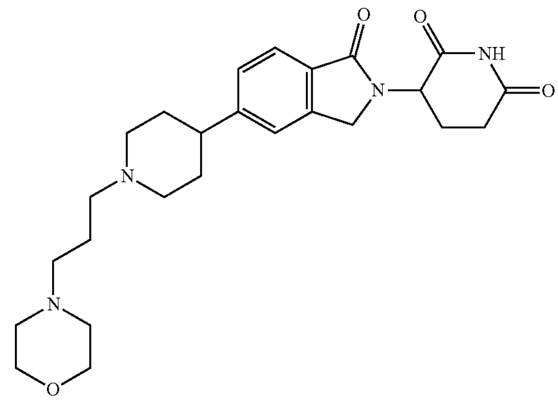 [SMILES: O=C1CCC(N2Cc3cc(C4CCN(CCCN5CCOCC5)CC4)ccc3C2=O)C(=O)N1] | 3-(5-(1-(3-morpholinopropyl)piperidin-4-yl)-1-oxoisoindolin-2-yl)piperidine-2,6-dione |
| I-24 | 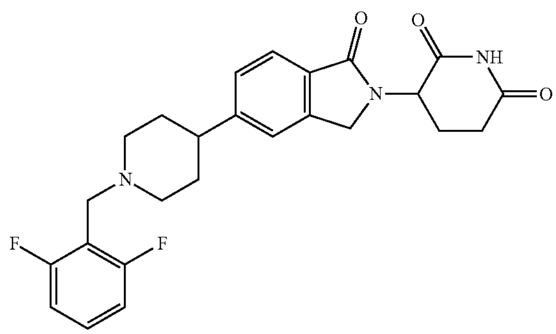 [SMILES: O=C1CCC(N2Cc3cc(C4CCN(Cc5c(F)cccc5F)CC4)ccc3C2=O)C(=O)N1] | 3-(5-(1-(2,6-difluorobenzyl)piperidin-4-yl)-1-oxoisoindolin-2-yl)piperidine-2,6-dione |
| I-25 | 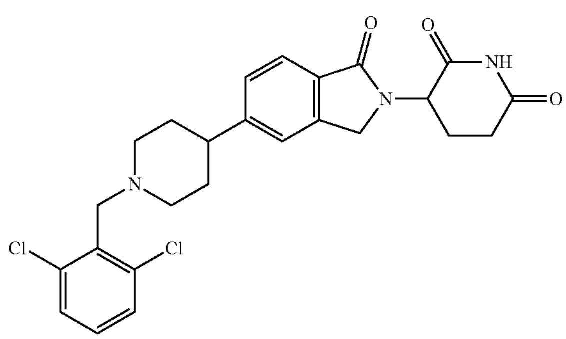 [SMILES: O=C1CCC(N2Cc3cc(C4CCN(Cc5c(Cl)cccc5Cl)CC4)ccc3C2=O)C(=O)N1] | 3-(5-(1-(2,6-dichlorobenzyl)piperidin-4-yl)-1-oxoisoindolin-2-yl)piperidine-2,6-dione |
| I-26 | 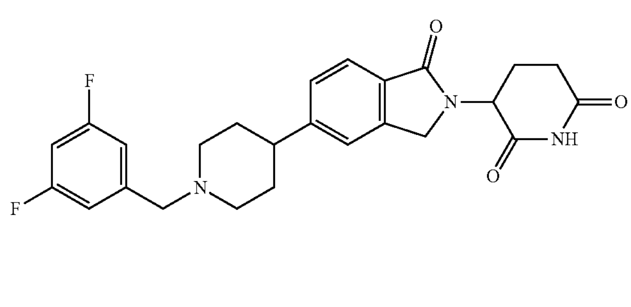 [SMILES: O=C1CCC(N2Cc3cc(C4CCN(Cc5cc(F)cc(F)c5)CC4)ccc3C2=O)C(=O)N1] | 3-(5-(1-(3,5-difluorobenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-27 | 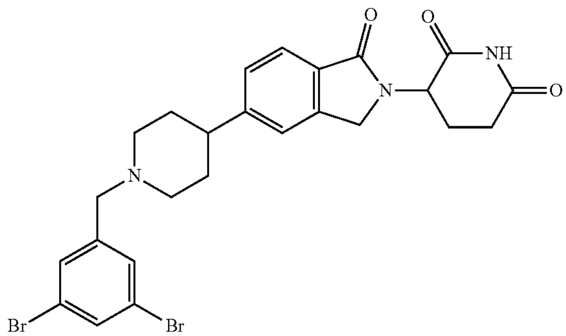 [SMILES: O=C1CCC(N2Cc3cc(C4CCN(Cc5cc(F)cc(Cl)c5)CC4)ccc3C2=O)C(=O)N1] | 3-(5-(1-(3,5-dibromobenzyl)piperidin-4-yl)-1-oxoisoindolin-2-yl)piperidine-2,6-dione |
| I-28 | 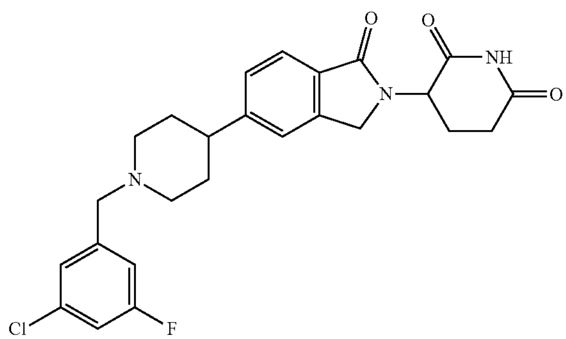 | 3-(5-(1-(3-chloro-5-fluorobenzyl)piperidin-4-yl)-1-oxoisoindolin-2-yl)piperidine-2,6-dione |
| I-29 | 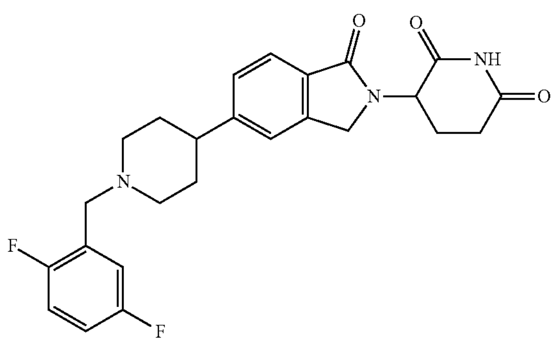 [SMILES: O=C1CCC(N2Cc3cc(C4CCN(Cc5cc(F)ccc5F)CC4)ccc3C2=O)C(=O)N1] | 3-(5-(1-(2,5-difluorobenzyl)piperidin-4-yl)-1-oxoisoindolin-2-yl)piperidine-2,6-dione |
| I-30 | 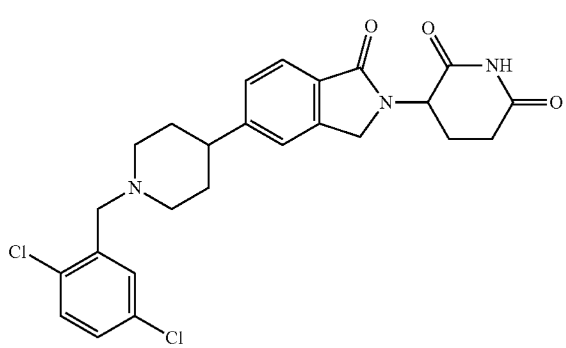 [SMILES: O=C1CCC(N2Cc3cc(C4CCN(Cc5cc(Cl)ccc5Cl)CC4)ccc3C2=O)C(=O)N1] | 3-(5-(1-(2,5-dichlorobenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-31 | 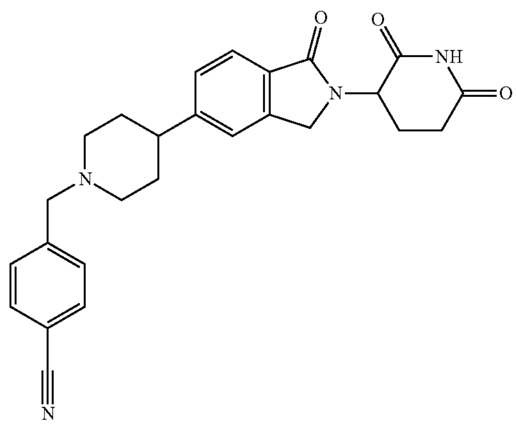 [SMILES: N#Cc1ccc(CN2CCC(c3ccc4c(c3)CN(C3CCC(=O)NC3=O)C4=O)CC2)cc1] | 4-((4-(2-(2,6-dioxo-piperidin-3-yl)-1-oxoisoindolin-5-yl)piperidin-1-yl)methyl)benzonitrile (or 3-(5-(1-(4-nitrilebenzyl)piperidin-4-yl)-1-oxoisoindolin-2-yl)piperidine-2,6-dione) |
| I-32 | 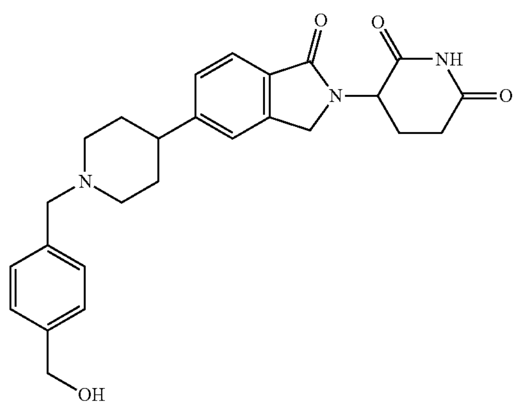 [SMILES: O=C1CCC(N2Cc3cc(C4CCN(Cc5ccc(CO)cc5)CC4)ccc3C2=O)C(=O)N1] | 3-(5-(1-(4-(hydroxymethyl)benzyl)piperidin-4-yl)-1-oxoisoindolin-2-yl)piperidine-2,6-dione |
| I-33 | 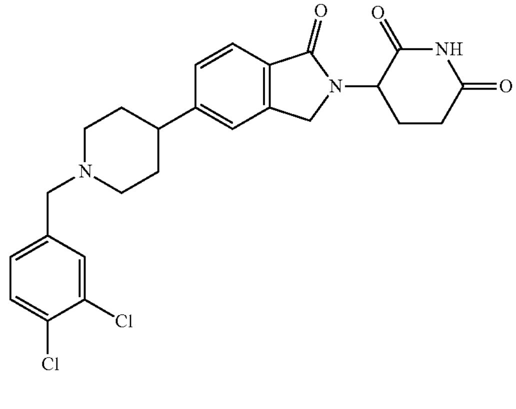 | 3-(5-(1-(3,4-dichlorobenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-34 | 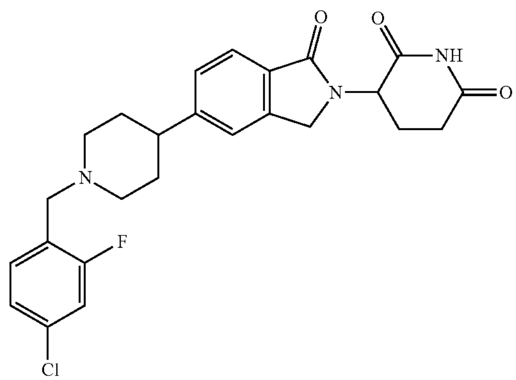 [SMILES: O=C1CCC(N2Cc3cc(C4CCN(Cc5ccc(Cl)cc5F)CC4)ccc3C2=O)C(=O)N1] | 3-(5-(1-(4-chloro-2-fluorobenzyl)piperidin-4-yl)-1-oxoisoindolin-2-yl)piperidine-2,6-dione |
| I-35 | 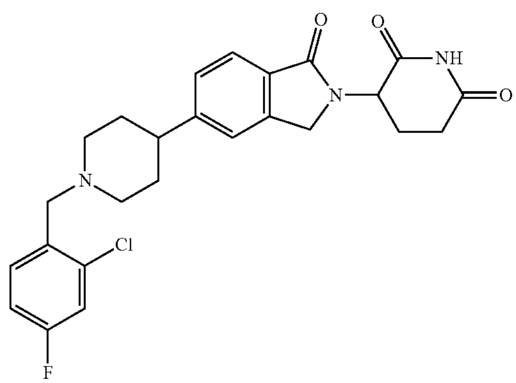 [SMILES: O=C1CCC(N2Cc3cc(C4CCN(Cc5ccc(F)cc5Cl)CC4)ccc3C2=O)C(=O)N1] | 3-(5-(1-(2-chloro-4-fluorobenzyl)piperidin-4-yl)-1-oxoisoindolin-2-yl)piperidine-2,6-dione |
| I-36 | 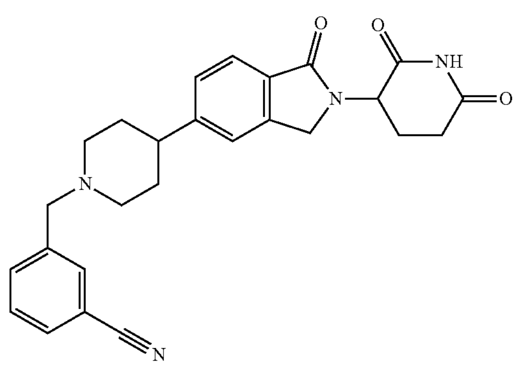 [SMILES: N#Cc1cccc(CN2CCC(c3ccc4c(c3)CN(C3CCC(=O)NC3=O)C4=O)CC2)c1] | 3-((4-(2-(2,6-dioxopiperidin-3-yl)-1-oxoisoindolin-5-yl)piperidin-1-yl)methyl)benzonitrile |
| I-37 | 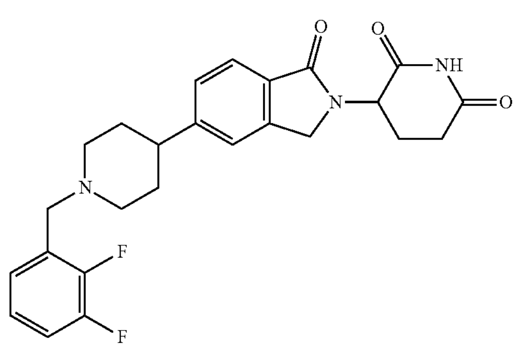 [SMILES: O=C1CCC(N2Cc3cc(C4CCN(Cc5cccc(F)c5F)CC4)ccc3C2=O)C(=O)N1] | 3-(5-(1-(2,3-difluorobenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-38 | 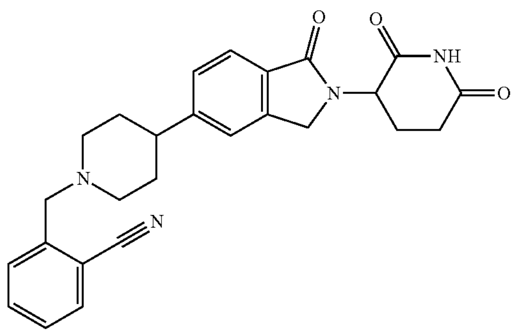 [SMILES: N#Cc1ccccc1CN1CCC(c2ccc3c(c2)CN(C2CCC(=O)NC2=O)C3=O)CC1] | 2-((4-(2-(2,6-dioxopiperidin-3-yl)-1-oxoisoindolin-5-yl)piperidin-1-yl)methyl)benzonitrile |
| I-39 | 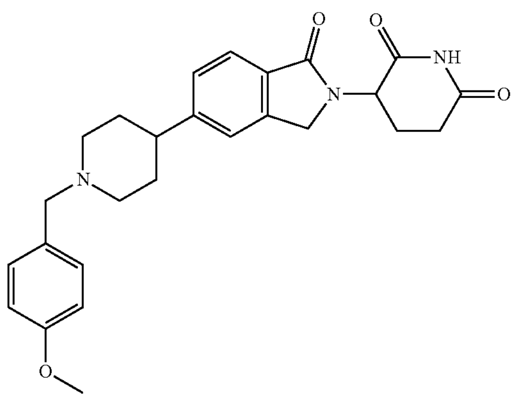 | 3-(5-(1-(4-methoxybenzyl)piperidin-4-yl)-1-oxoisoindolin-2-yl)piperidine-2,6-dione |
| I-40 | 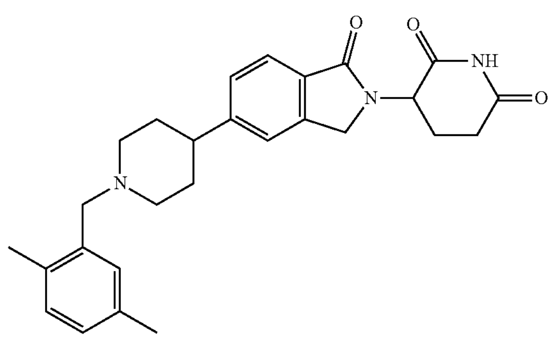 [SMILES: Cc1ccc(C)c(CN2CCC(c3ccc4c(c3)CN(C3CCC(=O)NC3=O)C4=O)CC2)c1] | 3-(5-(1-(2,5-dimethylbenzyl)piperidin-4-yl)-1-oxoisoindolin-2-yl)piperidine-2,6-dione |
| I-41 | 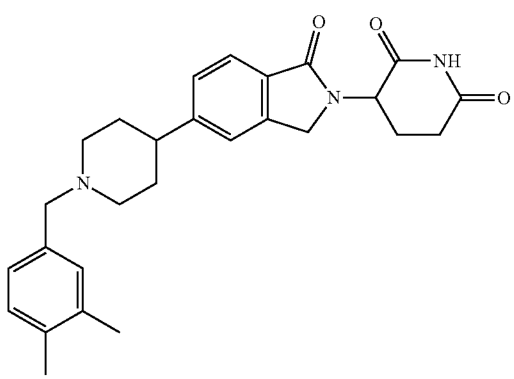 | 3-(5-(1-(3,4-dimethylbenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-42 | 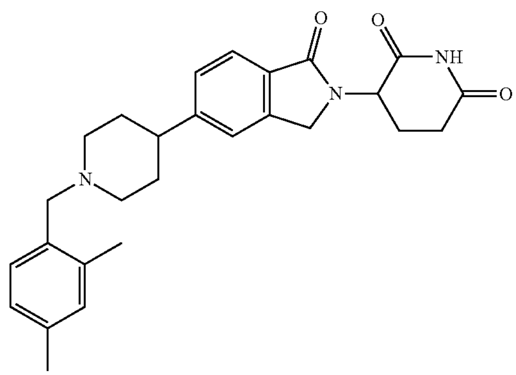 [SMILES: Cc1ccc(CN2CCC(c3ccc4c(c3)CN(C3CCC(=O)NC3=O)C4=O)CC2)c(C)c1] | 3-(5-(1-(2,4-dimethylbenzyl)piperidin-4-yl)-1-oxoisoindolin-2-yl)piperidine-2,6-dione |
| I-43 | 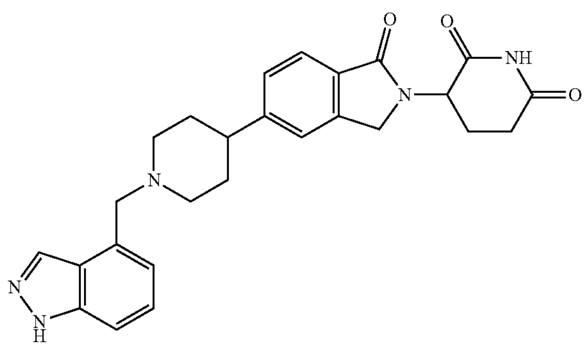 [SMILES: O=C1CCC(N2Cc3cc(C4CCN(Cc5cccc6[nH]ncc56)CC4)ccc3C2=O)C(=O)N1] | 3-(5-(1-((1H-indazol-4-yl)methyl)piperidin-4-yl)-1-oxoisoindolin-2-yl)piperidine-2,6-dione |
| I-44 | 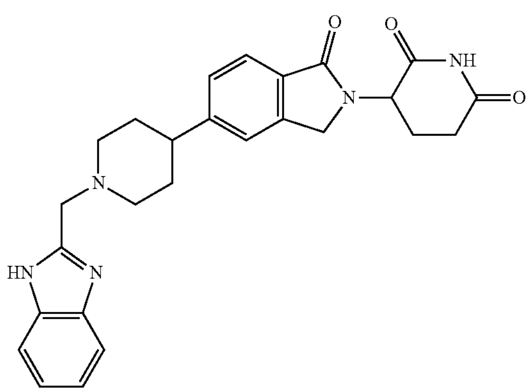 [SMILES: O=C1CCC(N2Cc3cc(C4CCN(Cc5nc6ccccc6[nH]5)CC4)ccc3C2=O)C(=O)N1] | 3-(5-(1-((1H-benzo[d]imidazol-2-yl)methyl)piperidin-4-yl)-1-oxoisoindolin-2-yl)piperidine-2,6-dione |
| I-45 | 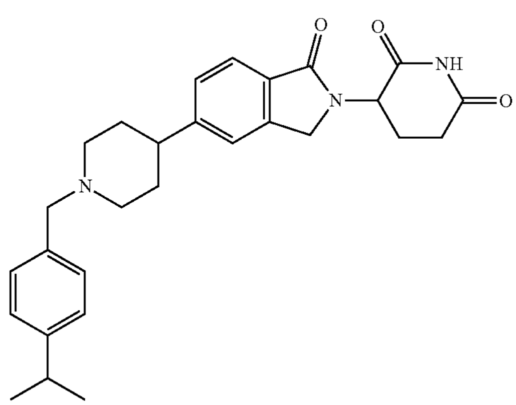 [SMILES: CC(C)c1ccc(CN2CCC(c3ccc4c(c3)CN(C3CCC(=O)NC3=O)C4=O)CC2)cc1] | 3-(5-(1-(4-isopropylbenzyl)piperidin-4-yl)-1-oxoisoindolin-2-yl)piperidine-2,6-dione |

TABLE 29-continued

Exemplary degradation compounds

| Cmpd No. | Structure | Compound Name |
| --- | --- | --- |
| I-46 | 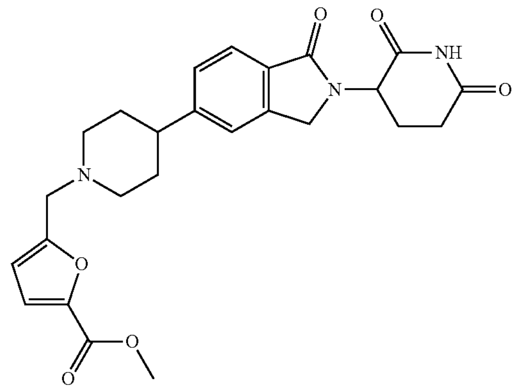 [SMILES: COC(=O)c1ccc(CN2CCC(c3ccc4c(c3)CN(C3CCC(=O)NC3=O)C4=O)CC2)o1] | methyl 5-((4-(2-(2,6-dioxopiperidin-3-yl)-1-oxoiso-indolin-5-yl)piperidin-1-yl)methyl)furan-2-carboxylate |
| I-47 | 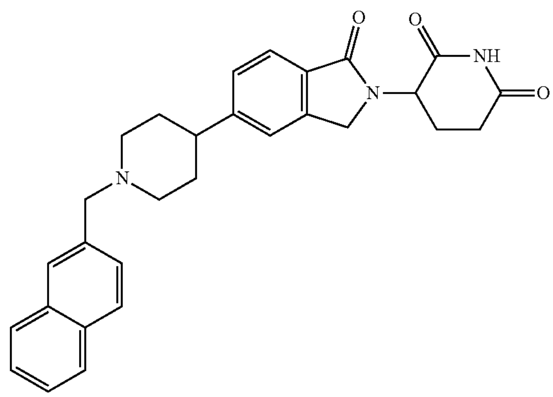 [SMILES: O=C1CCC(N2Cc3cc(C4CCN(Cc5ccc6ccccc6c5)CC4)ccc3C2=O)C(=O)N1] | 3-(5-(1-(naphthalen-2-ylmethyl)piperidin-4-yl)-1-oxoisoindolin-2-yl)piperidine-2,6-dione |
| I-48 | 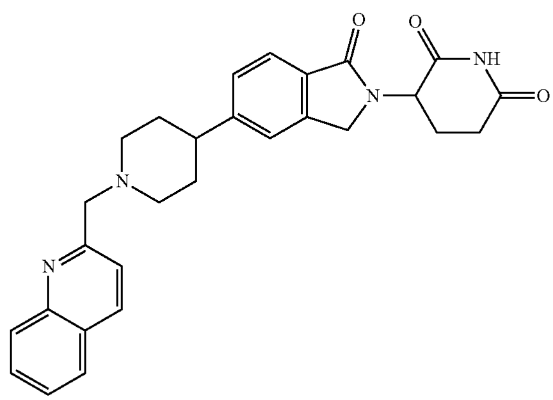 [SMILES: O=C1CCC(N2Cc3cc(C4CCN(Cc5ccc6ccccc6n5)CC4)ccc3C2=O)C(=O)N1] | 3-(1-oxo-5-(1-(quinolin-2-ylmethyl)piperidin-4-yl)isoindolin-2-yl)piperidine-2,6-dione |
| I-49 | 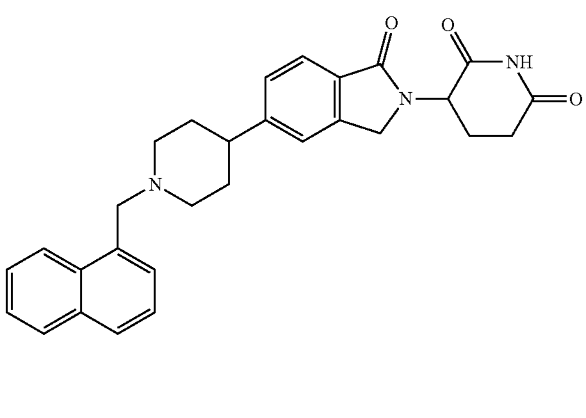 [SMILES: O=C1CCC(N2Cc3cc(C4CCN(Cc5cccc6ccccc56)CC4)ccc3C2=O)C(=O)N1] | 3-(5-(1-(naphthalen-1-ylmethyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-50 | 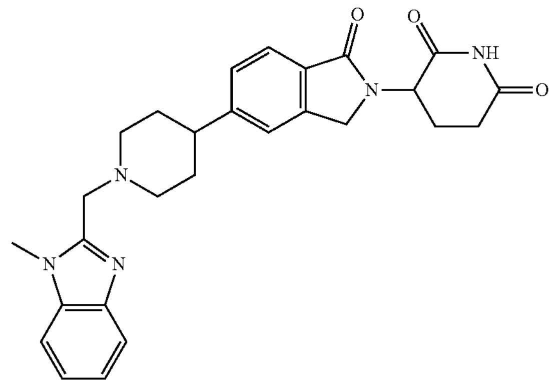 [SMILES: Cn1c(CN2CCC(c3ccc4c(c3)CN(C3CCC(=O)NC3=O)C4=O)CC2)nc2ccccc21] | 3-(5-(1-((1-methyl-1H-benzo[d]imidazol-2-yl)methyl)piperidin-4-yl)-1-oxoisoindolin-2-yl)piperidine-2,6-dione |
| I-51 | 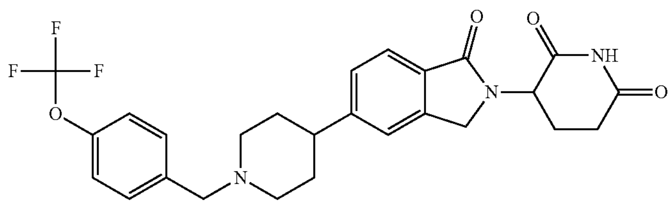 [SMILES: O=C1CCC(N2Cc3cc(C4CCN(Cc5ccc(OC(F)(F)F)cc5)CC4)ccc3C2=O)C(=O)N1] | 3-(1-oxo-5-(1-(4-(trifluoromethoxy)benzyl)piperidin-4-yl)isoindolin-2-yl)piperidine-2,6-dione |
| I-52 | 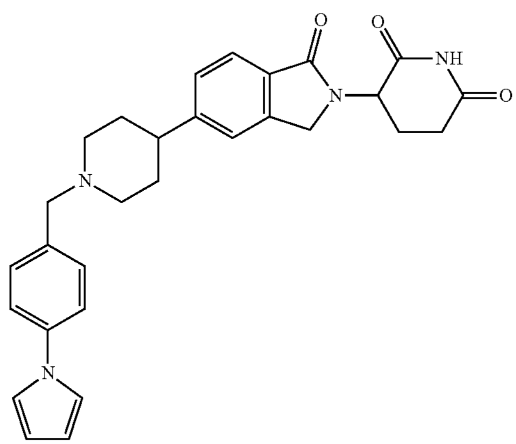 [SMILES: O=C1CCC(N2Cc3cc(C4CCN(Cc5ccc(-n6cccc6)cc5)CC4)ccc3C2=O)C(=O)N1] | 3-(5-(1-(4-(1H-pyrrol-1-yl)benzyl)piperidin-4-yl)-1-oxoisoindolin-2-yl)piperidine-2,6-dione |
| I-53 | 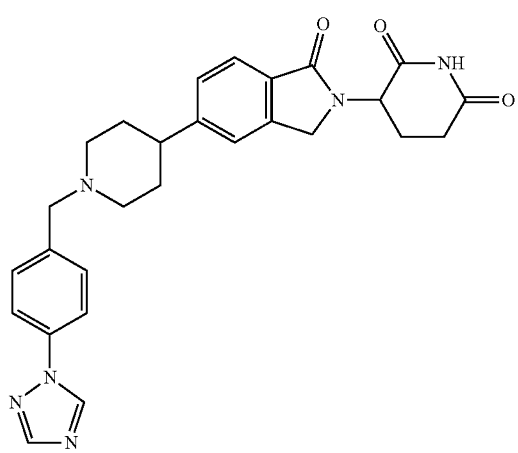 [SMILES: O=C1CCC(N2Cc3cc(C4CCN(Cc5ccc(-n6cncn6)cc5)CC4)ccc3C2=O)C(=O)N1] | 3-(5-(1-(4-(1H-1,2,4-triazol-1-yl)benzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-54 | 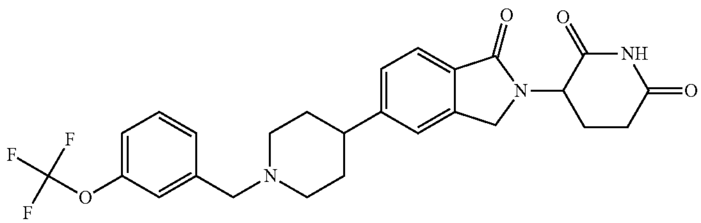 [SMILES: O=C1CCC(N2Cc3cc(C4CCN(Cc5cccc(OC(F)(F)F)c5)CC4)ccc3C2=O)C(=O)N1] | 3-(1-oxo-5-(1-(3-(trifluoromethoxy)benzyl)piperidin-4-yl)isoindolin-2-yl)piperidine-2,6-dione |
| I-55 | 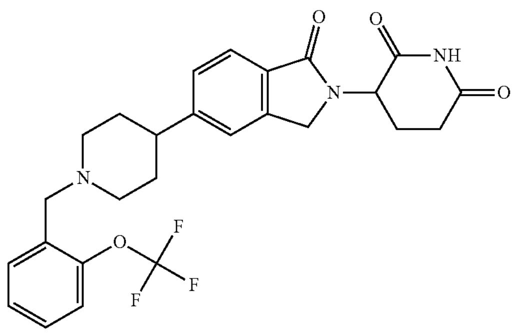 [SMILES: O=C1CCC(N2Cc3cc(C4CCN(Cc5ccccc5OC(F)(F)F)CC4)ccc3C2=O)C(=O)N1] | 3-(1-oxo-5-(1-(2-(trifluoromethoxy)benzyl)piperidin-4-yl)isoindolin-2-yl)piperidine-2,6-dione |
| I-56 | 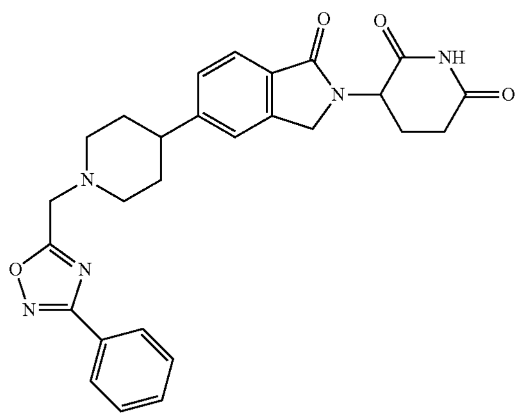 [SMILES: O=C1CCC(N2Cc3cc(C4CCN(Cc5nc(-c6ccccc6)no5)CC4)ccc3C2=O)C(=O)N1] | 3-(1-oxo-5-(1-((3-phenyl-1,2,4-oxadiazol-5-yl)methyl)piperidin-4-yl)isoindolin-2-yl)piperidine-2,6-dione |
| I-57 | 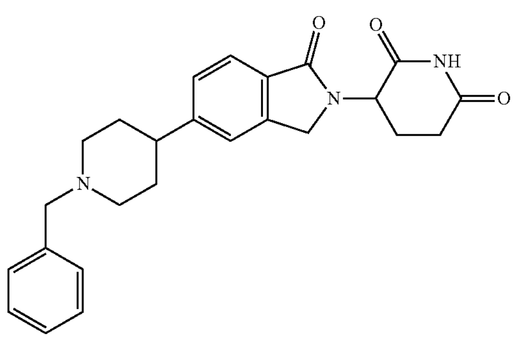 [SMILES: O=C1CCC(N2Cc3cc(C4CCN(Cc5ccccc5)CC4)ccc3C2=O)C(=O)N1] | 3-(5-(1-benzyl-piperidin-4-yl)-1-oxoisoindolin-2-yl)piperidine-2,6-dione |
| I-58 | 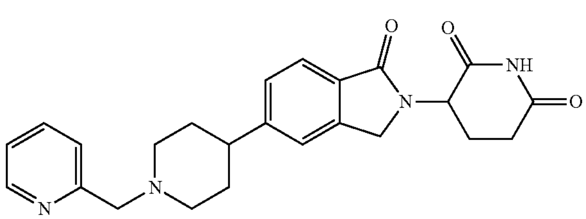 [SMILES: O=C1CCC(N2Cc3cc(C4CCN(Cc5ccccn5)CC4)ccc3C2=O)C(=O)N1] | 3-(1-oxo-5-(1-(pyridin-2-ylmethyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-59 | 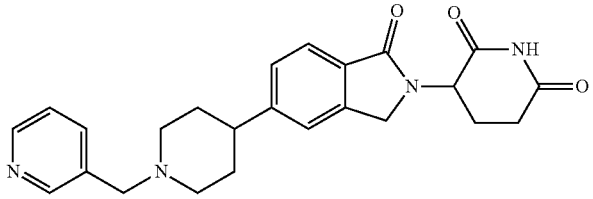 [SMILES: O=C1CCC(N2Cc3cc(C4CCN(Cc5cccnc5)CC4)ccc3C2=O)C(=O)N1] | 3-(1-oxo-5-(1-(pyridin-3-ylmethyl)piperidin-4-yl)isoindolin-2-yl)piperidine-2,6-dione |
| I-60 | 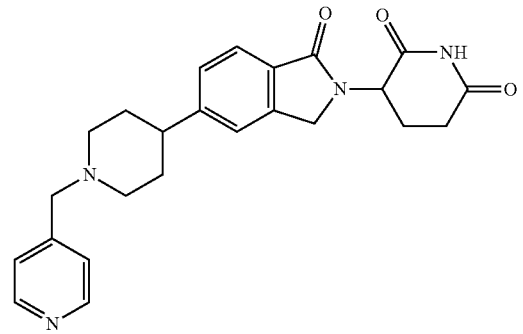 [SMILES: O=C1CCC(N2Cc3cc(C4CCN(Cc5ccncc5)CC4)ccc3C2=O)C(=O)N1] | 3-(1-oxo-5-(1-(pyridin-4-ylmethyl)piperidin-4-yl)isoindolin-2-yl)piperidine-2,6-dione |
| I-61 | 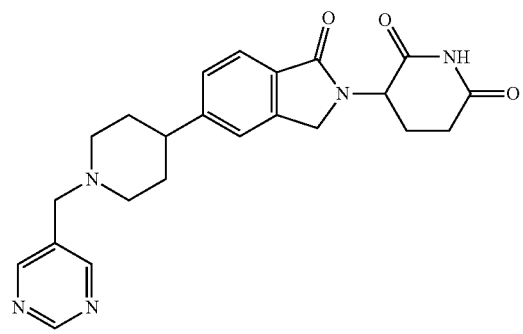 [SMILES: O=C1CCC(N2Cc3cc(C4CCN(Cc5cncnc5)CC4)ccc3C2=O)C(=O)N1] | 3-(1-oxo-5-(1-(pyrimidin-5-ylmethyl)piperidin-4-yl)isoindolin-2-yl)piperidine-2,6-dione |
| I-62 | 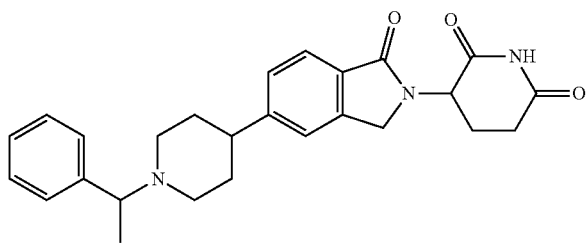 [SMILES: CC(c1ccccc1)N1CCC(c2ccc3c(c2)CN(C2CCC(=O)NC2=O)C3=O)CC1] | 3-(1-oxo-5-(1-(1-phenylethyl)piperidin-4-yl)isoindolin-2-yl)piperidine-2,6-dione |
| I-63 | 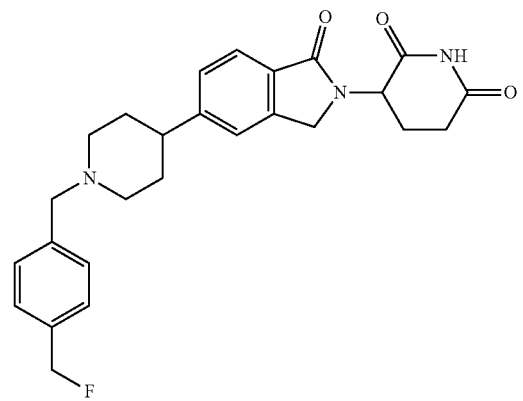 [SMILES: O=C1CCC(N2Cc3cc(C4CCN(Cc5ccc(CF)cc5)CC4)ccc3C2=O)C(=O)N1] | 3-(5-(1-(4-(fluoromethyl)benzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-64 | 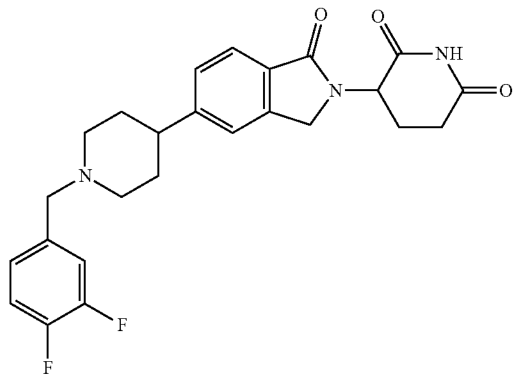 [SMILES: O=C1CCC(N2Cc3cc(C4CCN(Cc5ccc(F)c(F)c5)CC4)ccc3C2=O)C(=O)N1] | 3-(5-(1-(3,4-difluorobenzyl)piperidin-4-yl)-1-oxoisoindolin-2-yl)piperidine-2,6-dione |
| I-65 | 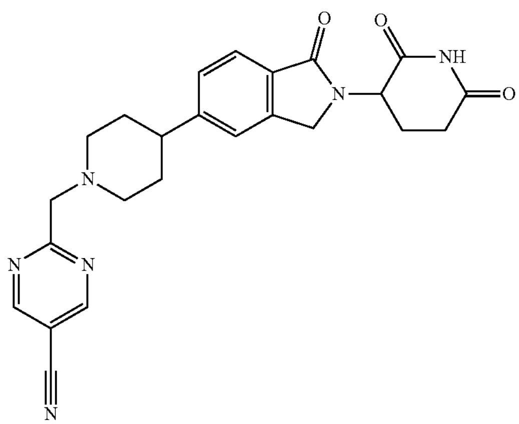 [SMILES: N#Cc1cnc(CN2CCC(c3ccc4c(c3)CN(C3CCC(=O)NC3=O)C4=O)CC2)nc1] | 2-((4-(2-(2,6-dioxopiperidin-3-yl)-1-oxoisoindolin-5-yl)piperidin-1-yl)methyl)pyrimidine-5-carbonitrile |
| I-66 | 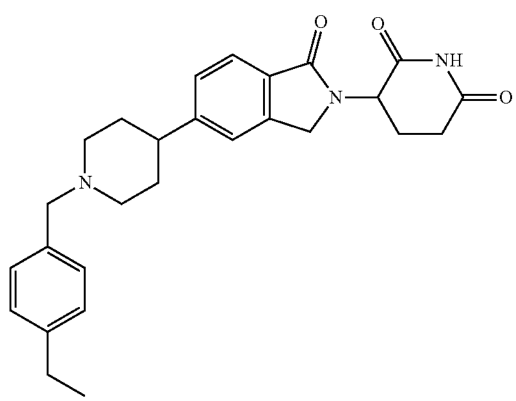 [SMILES: CCc1ccc(CN2CCC(c3ccc4c(c3)CN(C3CCC(=O)NC3=O)C4=O)CC2)cc1] | 3-(5-(1-(4-ethylbenzyl)piperidin-4-yl)-1-oxoisoindolin-2-yl)piperidine-2,6-dione |
| I-67 | 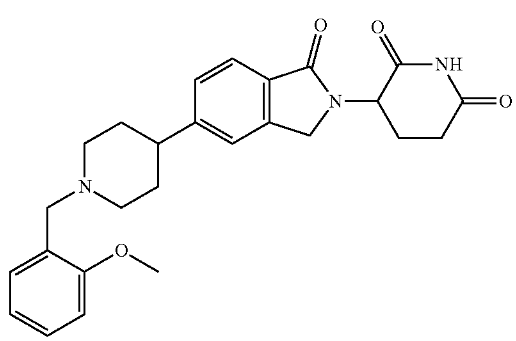 [SMILES: COc1ccccc1CN1CCC(c2ccc3c(c2)CN(C2CCC(=O)NC2=O)C3=O)CC1] | 3-(5-(1-(2-methoxybenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-68 | 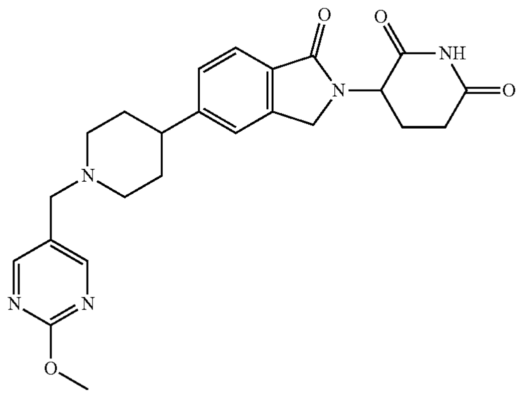 [SMILES: COc1ncc(CN2CCC(c3ccc4c(c3)CN(C3CCC(=O)NC3=O)C4=O)CC2)cn1] | 3-(5-(1-((2-methoxypyrimidin-5-yl)methyl)piperidin-4-yl)-1-oxoisoindolin-2-yl)piperidine-2,6-dione |
| I-69 | 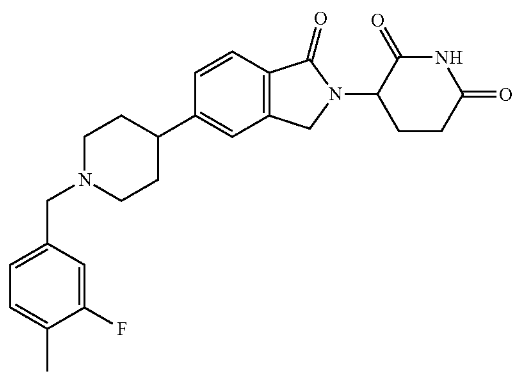 [SMILES: Cc1ccc(CN2CCC(c3ccc4c(c3)CN(C3CCC(=O)NC3=O)C4=O)CC2)cc1F] | 3-(5-(1-(3-fluoro-4-methylbenzyl)piperidin-4-yl)-1-oxoisoindolin-2-yl)piperidine-2,6-dione |
| I-70 | 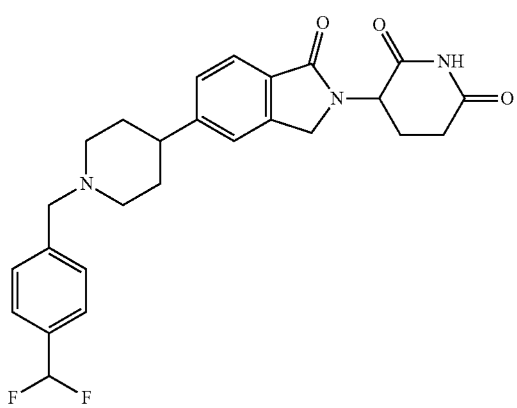 [SMILES: O=C1CCC(N2Cc3cc(C4CCN(Cc5ccc(C(F)F)cc5)CC4)ccc3C2=O)C(=O)N1] | 3-(5-(1-(4-(difluoromethyl)benzyl)piperidin-4-yl)-1-oxoisoindolin-2-yl)piperidine-2,6-dione |
| I-71 | 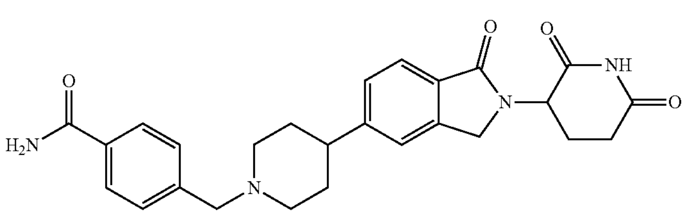 [SMILES: NC(=O)c1ccc(CN2CCC(c3ccc4c(c3)CN(C3CCC(=O)NC3=O)C4=O)CC2)cc1] | 4-((4-(2-(2,6-dioxopiperidin-3-yl)-1-oxoisoindolin-5-yl)piperidin-1-yl)methyl)benzamide |

TABLE 29-continued

Exemplary degradation compounds

| Cmpd No. | Structure | Compound Name |
| --- | --- | --- |
| I-72 | 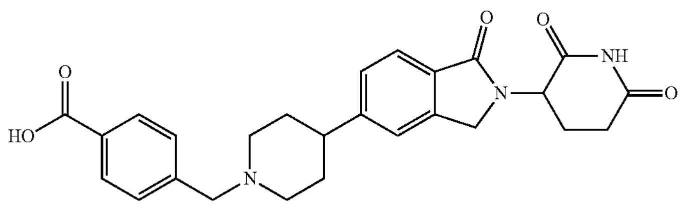 [SMILES: O=C1CCC(N2Cc3cc(C4CCN(Cc5ccc(C(=O)O)cc5)CC4)ccc3C2=O)C(=O)N1] | 4-((4-(2-(2,6-dioxopiperidin-3-yl)-1-oxoiso-indolin-5-yl)piperidin-1-yl)methyl)benzoic acid |
| I-73 | 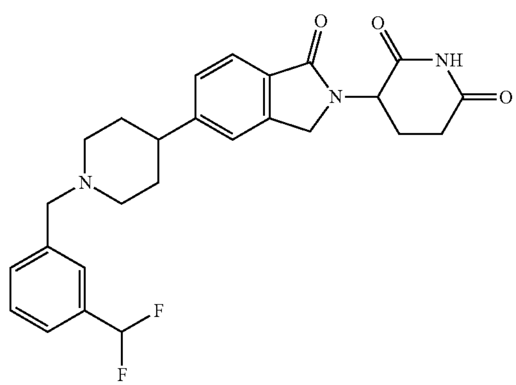 [SMILES: O=C1CCC(N2Cc3cc(C4CCN(Cc5cccc(C(F)F)c5)CC4)ccc3C2=O)C(=O)N1] | 3-(5-(1-(3-(difluoromethyl)benzyl)piperidin-4-yl)-1-oxoiso-indolin-2-yl)piperidine-2,6-dione |
| I-74 | 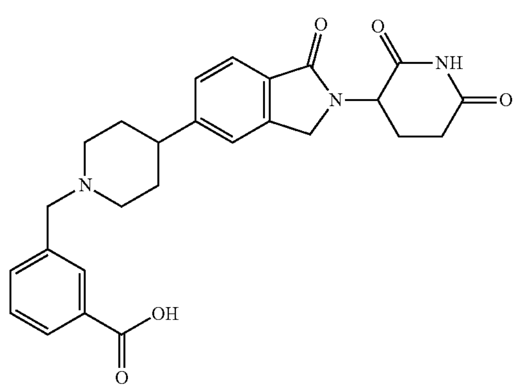 [SMILES: O=C1CCC(N2Cc3cc(C4CCN(Cc5cccc(C(=O)O)c5)CC4)ccc3C2=O)C(=O)N1] | 3-((4-(2-(2,6-dioxo-piperidin-3-yl)-1-oxoisoindolin-5-yl)piperidin-1-yl)methyl)benzoic acid |
| I-75 | 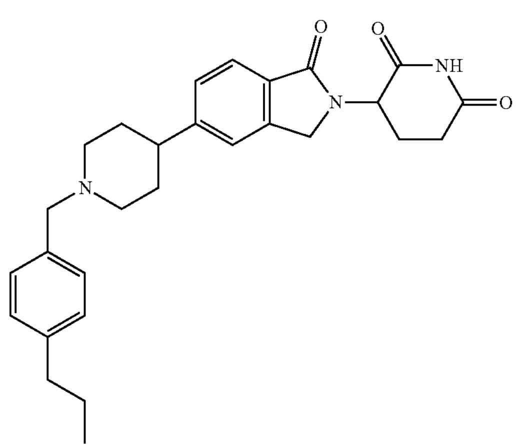 [SMILES: CCCc1ccc(CN2CCC(c3ccc4c(c3)CN(C3CCC(=O)NC3=O)C4=O)CC2)cc1] | 3-(1-oxo-5-(1-(4-propylbenzyl)piperidin-4-yl)isoindolin-2-yl)piperidine-2,6-dione |

TABLE 29-continued
Exemplary degradation compounds
| Cmpd No. | Structure | Compound Name |
|---|---|---|
| I-76 | 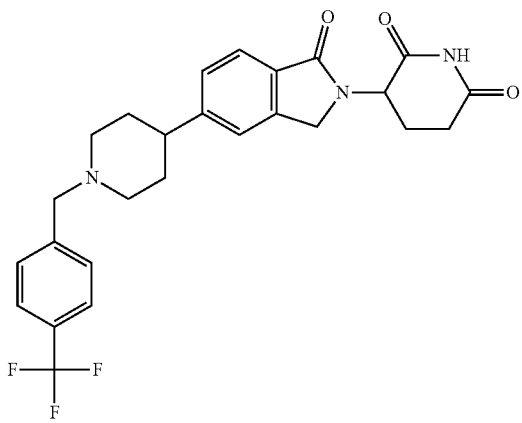 [SMILES: O=C1CCC(N2Cc3cc(C4CCN(Cc5ccc(C(F)(F)F)cc5)CC4)ccc3C2=O)C(=O)N1] | 3-(1-oxo-5-(1-(4-(trifluoromethyl)benzyl)piperidin-4-yl)isoindolin-2-yl)piperidine-2,6-dione |
| I-77 | 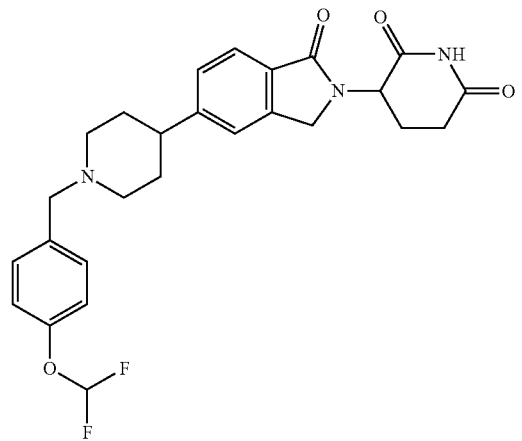 [SMILES: O=C1CCC(N2Cc3cc(C4CCN(Cc5ccc(OC(F)F)cc5)CC4)ccc3C2=O)C(=O)N1] | 3-(5-(1-(4-(difluoromethoxy)benzyl)piperidin-4-yl)-1-oxo-isoindolin-2-yl)piperidine-2,6-dione |
| I-78 | 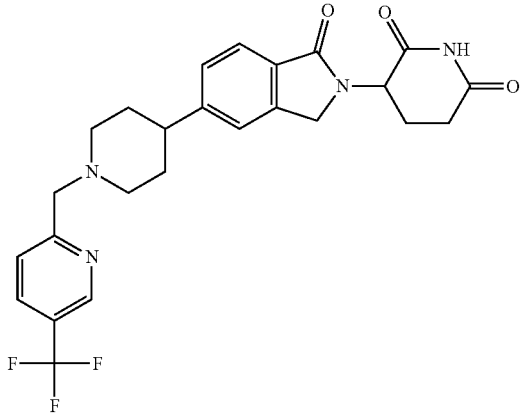 [SMILES: O=C1CCC(N2Cc3cc(C4CCN(Cc5ccc(C(F)(F)F)cn5)CC4)ccc3C2=O)C(=O)N1] | 3-(1-oxo-5-(1-((5-(trifluoromethyl)pyridin-2-yl)methyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-79 | 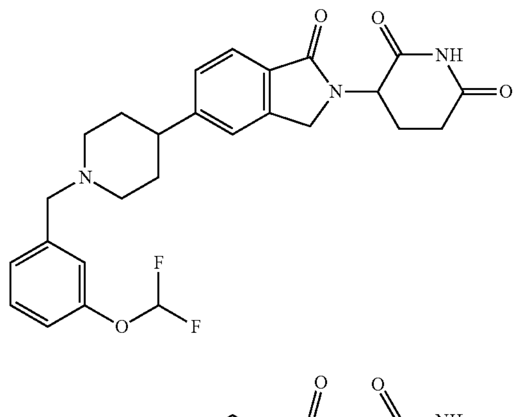 | 3-(5-(1-(3-(difluoromethoxy)benzyl)piperidin-4-yl)-1-oxoisoindolin-2-yl)piperidine-2,6-dione |
| I-80 | 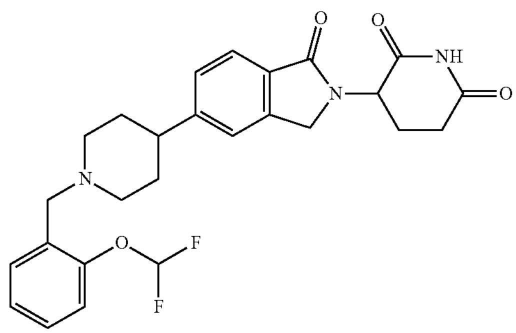 [SMILES: O=C1CCC(N2Cc3cc(C4CCN(Cc5ccccc5OC(F)F)CC4)ccc3C2=O)C(=O)N1] | 3-(5-(1-(2-(difluoromethoxy)benzyl)piperidin-4-yl)-1-oxoisoindolin-2-yl)piperidine-2,6-dione |
| I-81 | 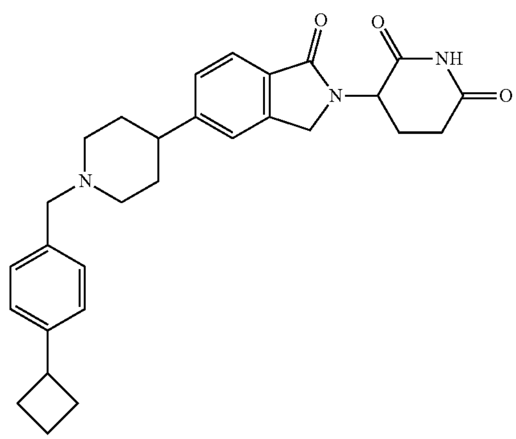 [SMILES: O=C1CCC(N2Cc3cc(C4CCN(Cc5ccc(C6CCC6)cc5)CC4)ccc3C2=O)C(=O)N1] | 3-(5-(1-(4-cyclobutylbenzyl)piperidin-4-yl)-1-oxoisoindolin-2-yl)piperidine-2,6-dione |
| I-82 | 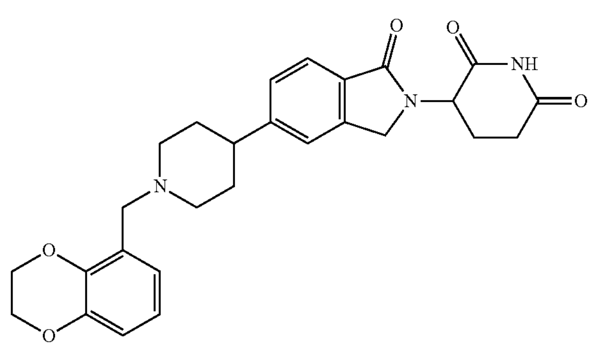 [SMILES: O=C1CCC(N2Cc3cc(C4CCN(Cc5cccc6c5OCCO6)CC4)ccc3C2=O)C(=O)N1] | 3-(5-(1-((2,3-dihydrobenzo[b][1,4]dioxin-5-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-83 | 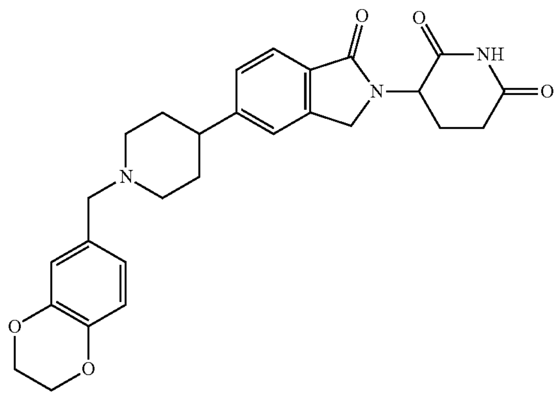 [SMILES: O=C1CCC(N2Cc3cc(C4CCN(Cc5ccc6c(c5)OCCO6)CC4)ccc3C2=O)C(=O)N1] | 3-(5-(1-((2,3-dihydrobenzo[b][1,4]dioxin-6-yl)methyl)piperidin-4-yl)-1-oxoisoindolin-2-yl)piperidine-2,6-dione |
| I-84 | 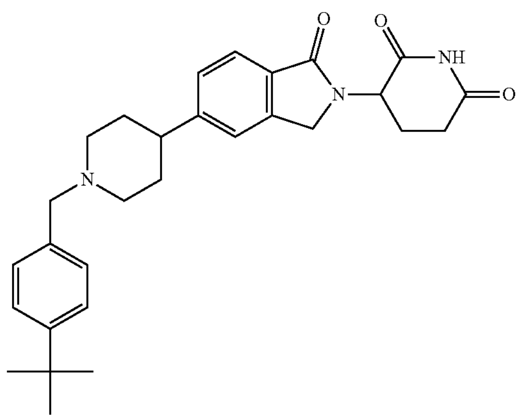 [SMILES: CC(C)(C)c1ccc(CN2CCC(c3ccc4c(c3)CN(C3CCC(=O)NC3=O)C4=O)CC2)cc1] | 3-(5-(1-(4-(tert-butyl)benzyl)piperidin-4-yl)-1-oxoisoindolin-2-yl)piperidine-2,6-dione |
| I-85 | 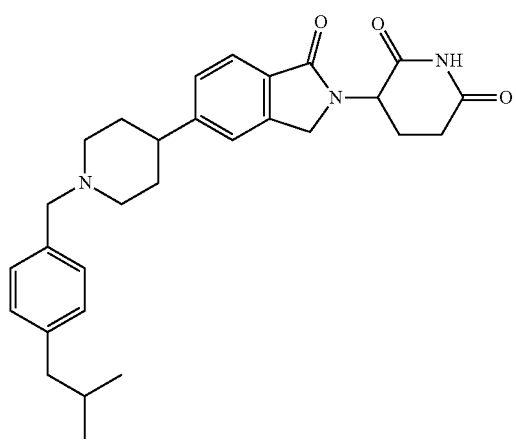 [SMILES: CC(C)Cc1ccc(CN2CCC(c3ccc4c(c3)CN(C3CCC(=O)NC3=O)C4=O)CC2)cc1] | 3-(5-(1-(4-isobutylbenzyl)piperidin-4-yl)-1-oxoisoindolin-2-yl)piperidine-2,6-dione |
| I-86 | 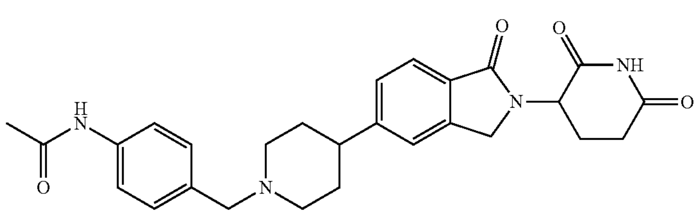 [SMILES: CC(=O)Nc1ccc(CN2CCC(c3ccc4c(c3)CN(C3CCC(=O)NC3=O)C4=O)CC2)cc1] | N-(4-((4-(2-(2,6-dioxopiperidin-3-yl)-1-oxoisoindolin-5-yl)piperidin-1-yl)methyl)phenyl)acetamide |

TABLE 29-continued

Exemplary degradation compounds

| Cmpd No. | Structure | Compound Name |
|---|---|---|
| I-87 | 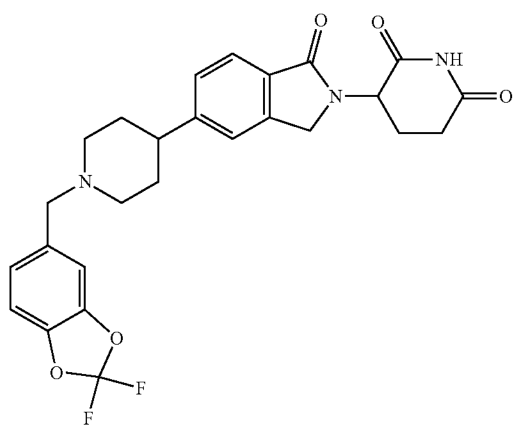 [SMILES: O=C1CCC(N2Cc3cc(C4CCN(Cc5ccc6c(c5)OC(F)(F)O6)CC4)ccc3C2=O)C(=O)N1] | 3-(5-(1-((2,2-difluorobenzo[d][1,3]dioxol-5-yl)methyl)piperidin-4-yl)-1-oxoisoindolin-2-yl)piperidine-2,6-dione |
| I-88 | 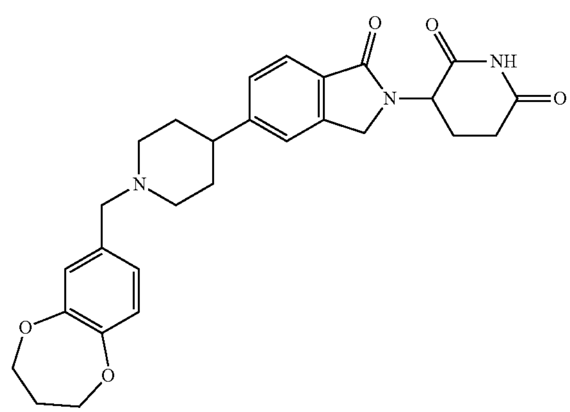 [SMILES: O=C1CCC(N2Cc3cc(C4CCN(Cc5ccc6c(c5)OCCCO6)CC4)ccc3C2=O)C(=O)N1] | 3-(5-(1-((3,4-dihydro-2H-benzo[b][1,4]dioxepin-7-yl)methyl)piperidin-4-yl)-1-oxoisoindolin-2-yl)piperidine-2,6-dione |
| I-89 | 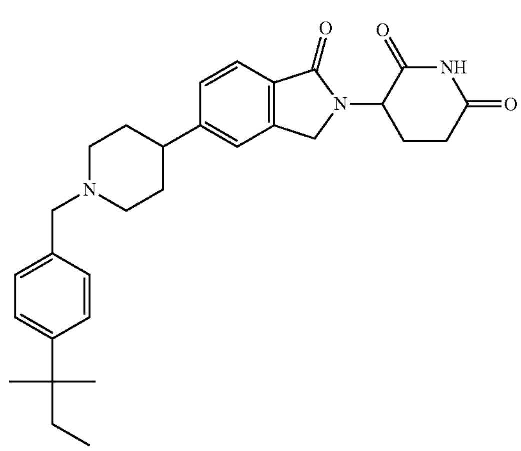 [SMILES: CCC(C)(C)c1ccc(CN2CCC(c3ccc4c(c3)CN(C3CCC(=O)NC3=O)C4=O)CC2)cc1] | 3-(1-oxo-5-(1-(4-(tert-pentyl)benzyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-90 | 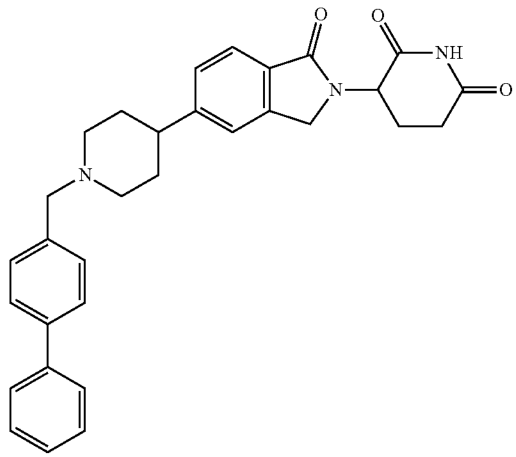 [SMILES: O=C1CCC(N2Cc3cc(C4CCN(Cc5ccc(-c6ccccc6)cc5)CC4)ccc3C2=O)C(=O)N1] | 3-(5-(1-([1,1'-biphenyl]-4-ylmethyl)piperidin-4-yl)-1-oxoisoindolin-2-yl)piperidine-2,6-dione |
| I-91 | 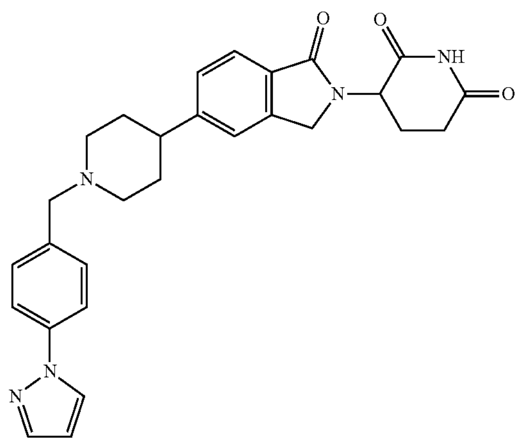 [SMILES: O=C1CCC(N2Cc3cc(C4CCN(Cc5ccc(-n6cccn6)cc5)CC4)ccc3C2=O)C(=O)N1] | 3-(5-(1-(4-(1H-pyrazol-1-yl)benzyl)piperidin-4-yl)-1-oxoisoindolin-2-yl)piperidine-2,6-dione |
| I-92 | 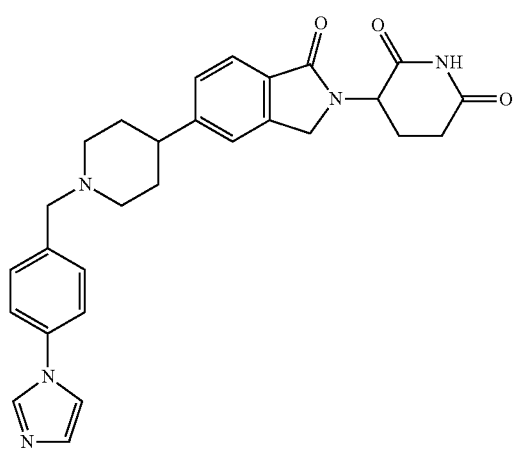 [SMILES: O=C1CCC(N2Cc3cc(C4CCN(Cc5ccc(-n6ccnc6)cc5)CC4)ccc3C2=O)C(=O)N1] | 3-(5-(1-(4-(1H-imidazol-1-yl)benzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-93 | 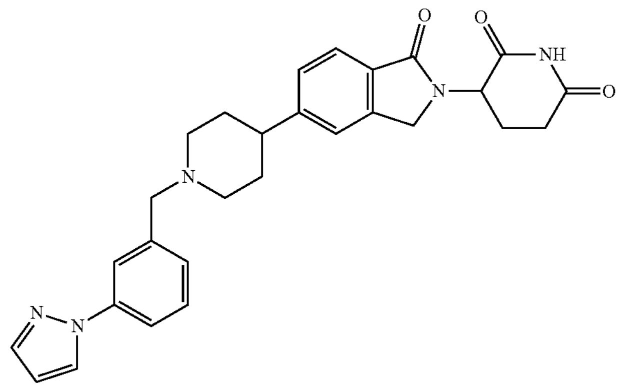 [SMILES: O=C1CCC(N2Cc3cc(C4CCN(Cc5cccc(-n6cccn6)c5)CC4)ccc3C2=O)C(=O)N1] | 3-(5-(1-(3-(1H-pyrazol-1-yl)benzyl)piperidin-4-yl)-1-oxoisoindolin-2-yl)piperidine-2,6-dione |
| I-94 | 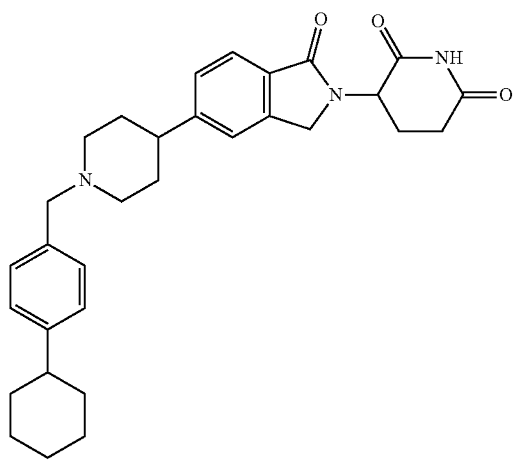 [SMILES: O=C1CCC(N2Cc3cc(C4CCN(Cc5ccc(C6CCCCC6)cc5)CC4)ccc3C2=O)C(=O)N1] | 3-(5-(1-(4-cyclohexylbenzyl)piperidin-4-yl)-1-oxoisoindolin-2-yl)piperidine-2,6-dione |
| I-95 | 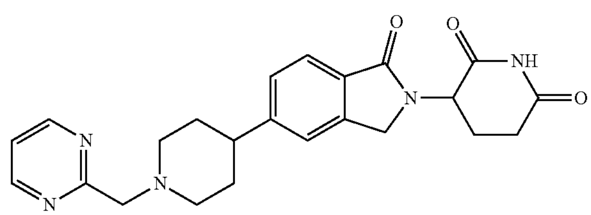 | 3-(1-oxo-5-(1-(pyrimidin-2-ylmethyl)piperidin-4-yl)isoindolin-2-yl)piperidine-2,6-dione |
| I-96 | 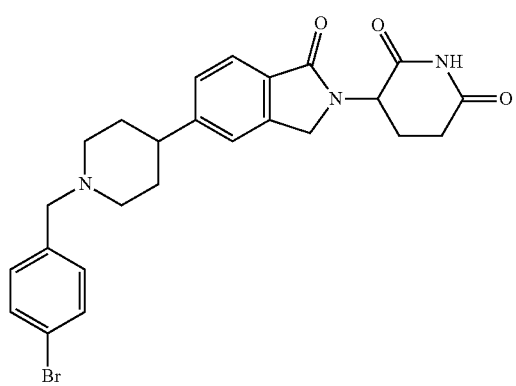 [SMILES: O=C1CCC(N2Cc3cc(C4CCN(Cc5ccc(Br)cc5)CC4)ccc3C2=O)C(=O)N1] | 3-(5-(1-(4-bromobenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-97 | 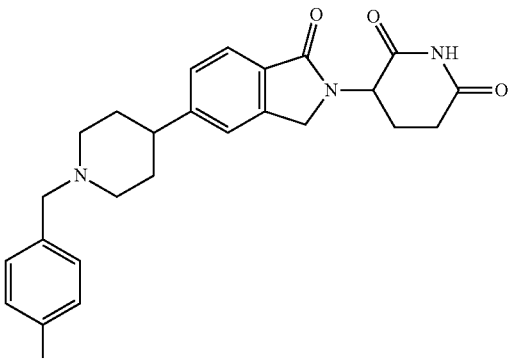 | 3-(5-(1-(4-chlorobenzyl)piperidin-4-yl)-1-oxoisoindolin-2-yl)piperidine-2,6-dione |
| I-98 | 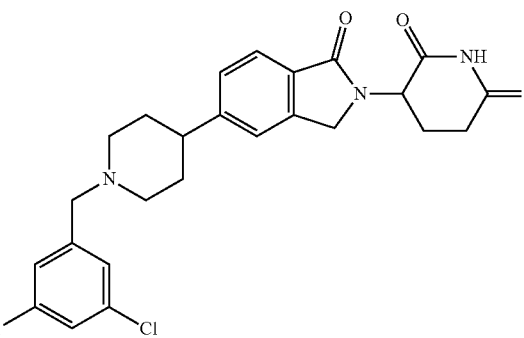 | 3-(5-(1-(3,5-dichlorobenzyl)piperidin-4-yl)-1-oxoisoindolin-2-yl)piperidine-2,6-dione |
| I-99 | 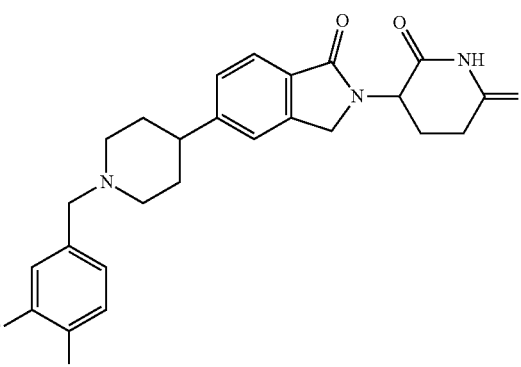 | 3-(5-(1-(4-chloro-3-fluorobenzyl)piperidin-4-yl)-1-oxoisoindolin-2-yl)piperidine-2,6-dione |
| I-100 | 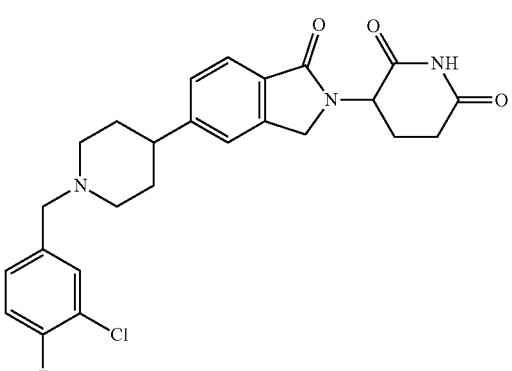 | 3-(5-(1-(3-chloro-4-fluorobenzyl)piperidin-4-yl)-1-oxoisoindolin-2-yl)piperidine-2,6-dione |

TABLE 29-continued

Exemplary degradation compounds

| Cmpd No. | Structure | Compound Name |
| --- | --- | --- |
| I-101 | 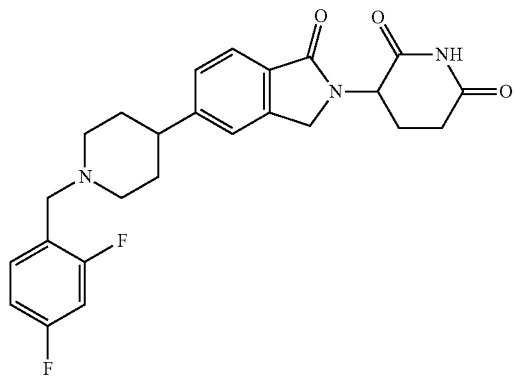 [SMILES: O=C1CCC(N2Cc3cc(C4CCN(Cc5ccc(F)cc5F)CC4)ccc3C2=O)C(=O)N1] | 3-(5-(1-(2,4-difluorobenzyl)piperidin-4-yl)-1-oxoisoindolin-2-yl)piperidine-2,6-dione |
| I-102 | 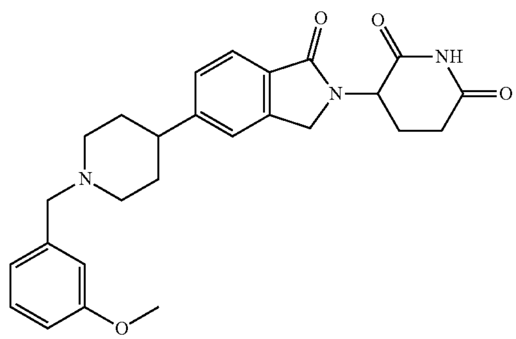 [SMILES: COc1cccc(CN2CCC(c3ccc4c(c3)CN(C3CCC(=O)NC3=O)C4=O)CC2)c1] | 3-(5-(1-(3-methoxybenzyl)piperidin-4-yl)-1-oxoisoindolin-2-yl)piperidine-2,6-dione |
| I-103 | 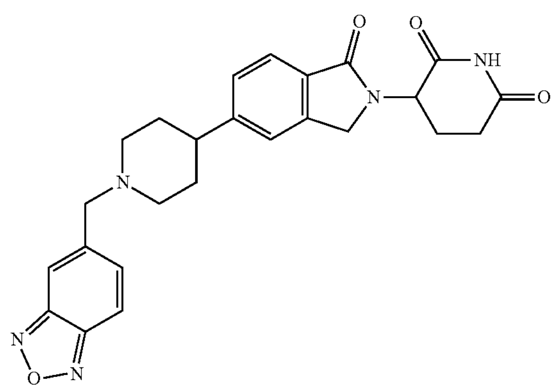 [SMILES: O=C1CCC(N2Cc3cc(C4CCN(Cc5ccc6nonc6c5)CC4)ccc3C2=O)C(=O)N1] | 3-(5-(1-(benzo[c][1,2,5]oxadiazol-5-ylmethyl)piperidin-4-yl)-1-oxoisoindolin-2-yl)piperidine-2,6-dione |
| I-104 | 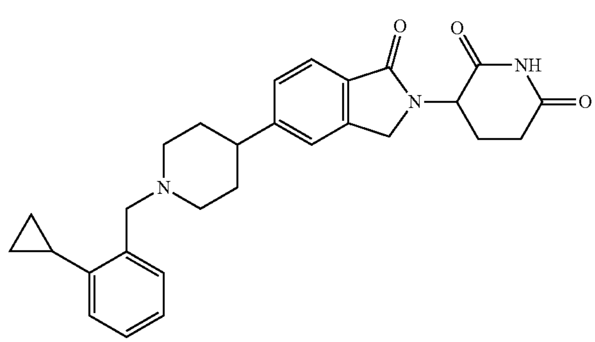 [SMILES: O=C1CCC(N2Cc3cc(C4CCN(Cc5ccccc5C5CC5)CC4)ccc3C2=O)C(=O)N1] | 3-(5-(1-(2-cyclopropylbenzyl)piperidin-4-yl)-1-oxoisoindolin-2-yl)piperidine-2,6-dione |

TABLE 29-continued

Exemplary degradation compounds

| Cmpd No. | Structure | Compound Name |
| --- | --- | --- |
| I-105 | 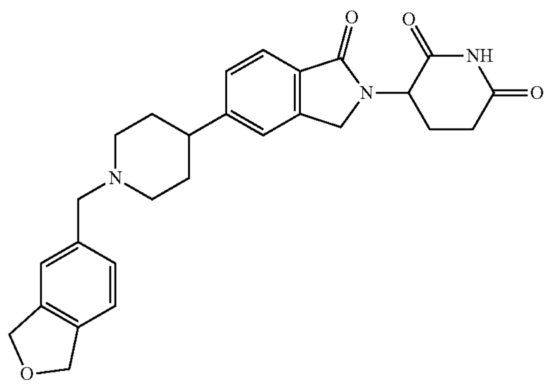 [SMILES: O=C1CCC(N2Cc3cc(C4CCN(Cc5ccc6c(c5)COC6)CC4)ccc3C2=O)C(=O)N1] | 3-(5-(1-((1,3-dihydroisobenzofuran-5-yl)methyl)piperidin-4-yl)-1-oxoisoindolin-2-yl)piperidine-2,6-dione |
| I-106 | 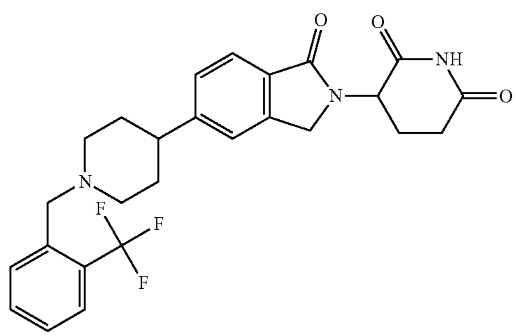 [SMILES: O=C1CCC(N2Cc3cc(C4CCN(Cc5ccccc5C(F)(F)F)CC4)ccc3C2=O)C(=O)N1] | 3-(1-oxo-5-(1-(2-(trifluoromethyl)benzyl)piperidin-4-yl)isoindolin-2-yl)piperidine-2,6-dione |
| I-107 | 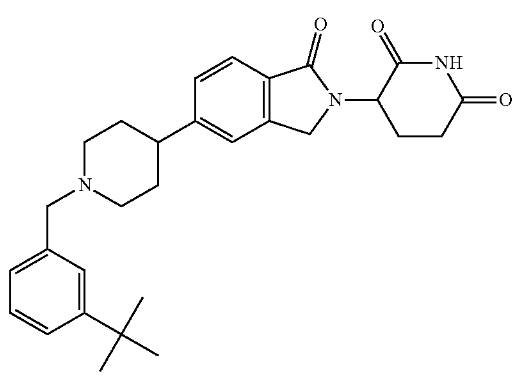 [SMILES: CC(C)(C)c1cccc(CN2CCC(c3ccc4c(c3)CN(C3CCC(=O)NC3=O)C4=O)CC2)c1] | 3-(5-(1-(3-(tert-butyl)benzyl)piperidin-4-yl)-1-oxoisoindolin-2-yl)piperidine-2,6-dione |
| I-108 | 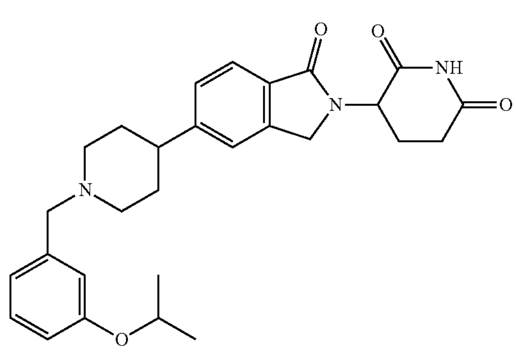 [SMILES: CC(C)Oc1cccc(CN2CCC(c3ccc4c(c3)CN(C3CCC(=O)NC3=O)C4=O)CC2)c1] | 3-(5-(1-(3-isopropoxybenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-109 | 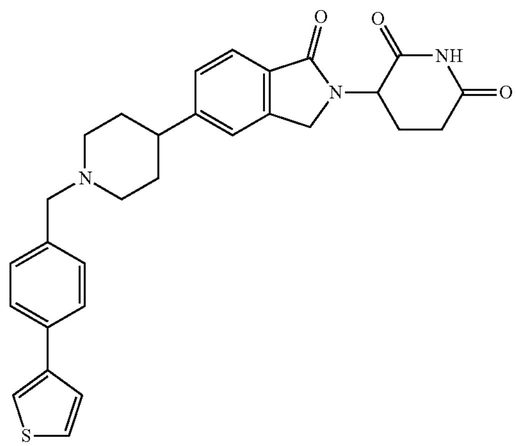 [SMILES: O=C1CCC(N2Cc3cc(C4CCN(Cc5ccc(-c6ccsc6)cc5)CC4)ccc3C2=O)C(=O)N1] | 3-(1-oxo-5-(1-(4-(thiophen-3-yl)benzyl)piperidin-4-yl)isoindolin-2-yl)piperidine-2,6-dione |
| I-110 | 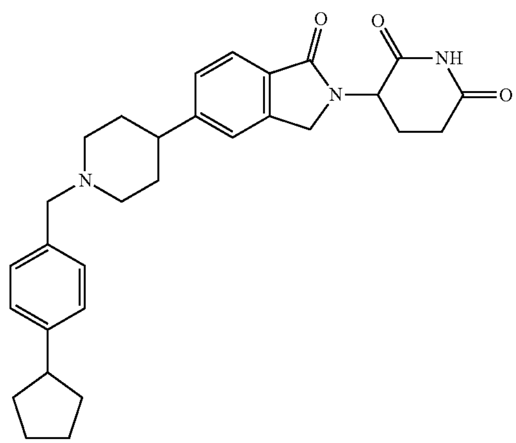 [SMILES: O=C1CCC(N2Cc3cc(C4CCN(Cc5ccc(C6CCCC6)cc5)CC4)ccc3C2=O)C(=O)N1] | 3-(5-(1-(4-cyclopentylbenzyl)piperidin-4-yl)-1-oxoisoindolin-2-yl)piperidine-2,6-dione |
| I-111 | 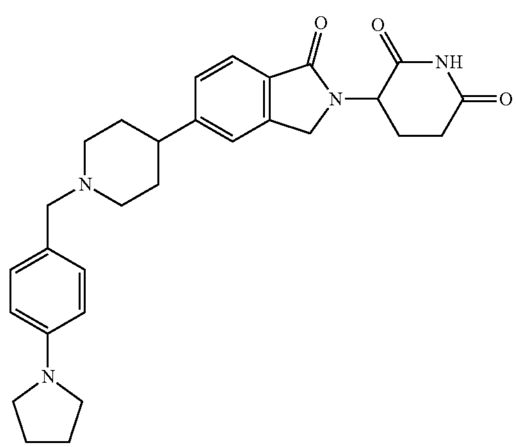 [SMILES: O=C1CCC(N2Cc3cc(C4CCN(Cc5ccc(N6CCCC6)cc5)CC4)ccc3C2=O)C(=O)N1] | 3-(1-oxo-5-(1-(4-(pyrrolidin-1-yl)benzyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-112 | 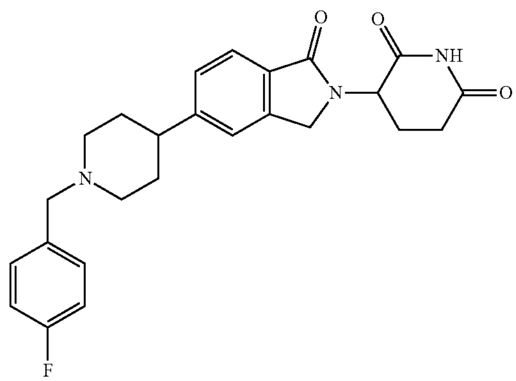 [SMILES: O=C1CCC(N2Cc3cc(C4CCN(Cc5ccc(F)cc5)CC4)ccc3C2=O)C(=O)N1] | 3-(5-(1-(4-fluorobenzyl)piperidin-4-yl)-1-oxoisoindolin-2-yl)piperidine-2,6-dione |
| I-113 | 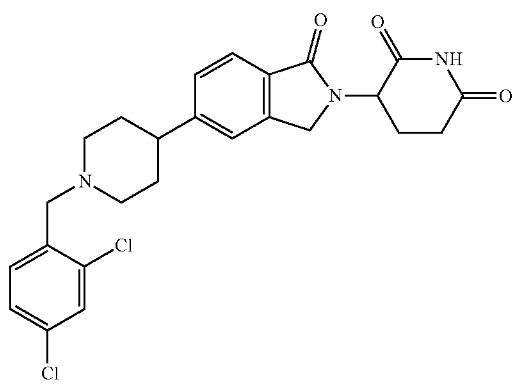 [SMILES: O=C1CCC(N2Cc3cc(C4CCN(Cc5ccc(Cl)cc5Cl)CC4)ccc3C2=O)C(=O)N1] | 3-(5-(1-(2,4-dichlorobenzyl)piperidin-4-yl)-1-oxoisoindolin-2-yl)piperidine-2,6-dione |
| I-114 | 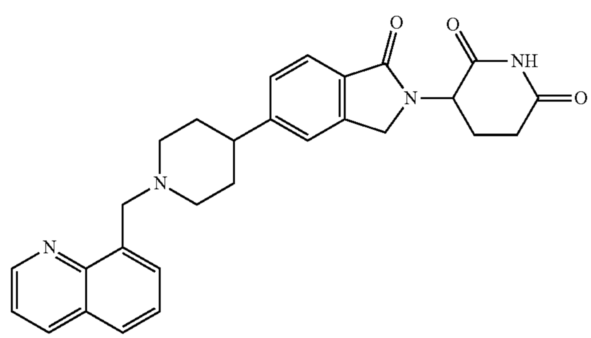 | 3-(1-oxo-5-(1-(quinolin-8-ylmethyl)piperidin-4-yl)isoindolin-2-yl)piperidine-2,6-dione |
| I-115 | 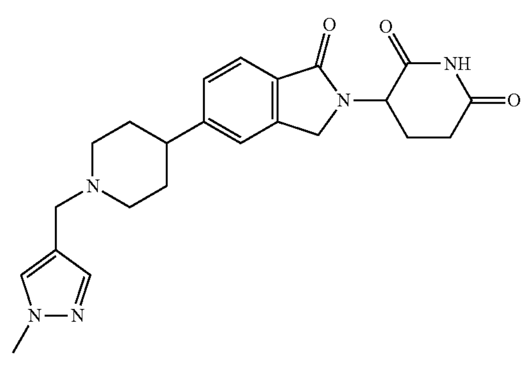 [SMILES: Cn1cc(CN2CCC(c3ccc4c(c3)CN(C3CCC(=O)NC3=O)C4=O)CC2)cn1] | 3-(5-(1-((1-methyl-1H-pyrazol-4-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-116 | 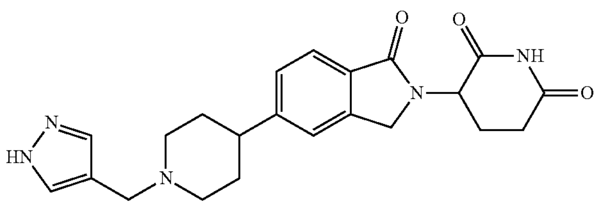 [SMILES: O=C1CCC(N2Cc3cc(C4CCN(Cc5cn[nH]c5)CC4)ccc3C2=O)C(=O)N1] | 3-(5-(1-((1H-pyrazol-4-yl)methyl)piperidin-4-yl)-1-oxoisoindolin-2-yl)piperidine-2,6-dione |
| I-117 | 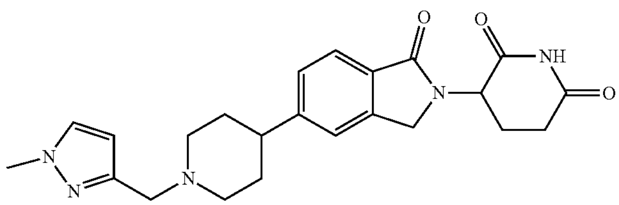 [SMILES: Cn1ccc(CN2CCC(c3ccc4c(c3)CN(C3CCC(=O)NC3=O)C4=O)CC2)n1] | 3-(5-(1-((1-methyl-1H-pyrazol-3-yl)methyl)piperidin-4-yl)-1-oxoisoindolin-2-yl)piperidine-2,6-dione |
| I-118 | 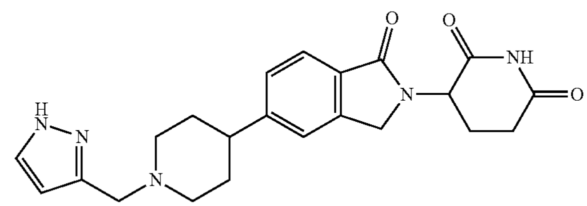 [SMILES: O=C1CCC(N2Cc3cc(C4CCN(Cc5cc[nH]n5)CC4)ccc3C2=O)C(=O)N1] | 3-(5-(1-((1H-pyrazol-3-yl)methyl)piperidin-4-yl)-1-oxoisoindolin-2-yl)piperidine-2,6-dione |
| I-119 | 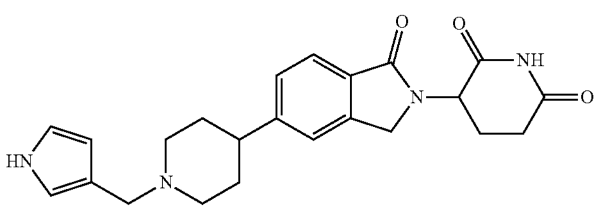 [SMILES: O=C1CCC(N2Cc3cc(C4CCN(Cc5cc[nH]c5)CC4)ccc3C2=O)C(=O)N1] | 3-(5-(1-((1H-pyrrol-3-yl)methyl)piperidin-4-yl)-1-oxoisoindolin-2-yl)piperidine-2,6-dione |
| I-120 | 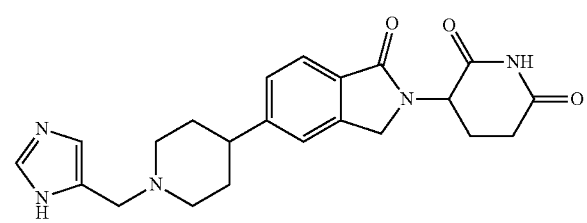 [SMILES: O=C1CCC(N2Cc3cc(C4CCN(Cc5cnc[nH]5)CC4)ccc3C2=O)C(=O)N1] | 3-(5-(1-((1H-imidazol-5-yl)methyl)piperidin-4-yl)-1-oxoisoindolin-2-yl)piperidine-2,6-dione |
| I-121 | 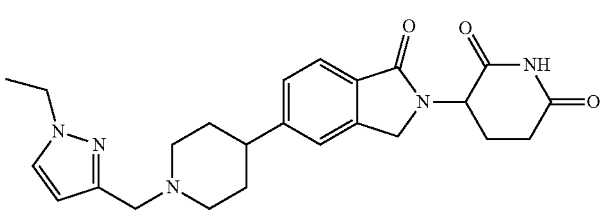 [SMILES: CCn1ccc(CN2CCC(c3ccc4c(c3)CN(C3CCC(=O)NC3=O)C4=O)CC2)n1] | 3-(5-(1-((1-ethyl-1H-pyrazol-3-yl)methyl)piperidin-4-yl)-1-oxoisoindolin-2-yl)piperidine-2,6-dione |
| I-122 | 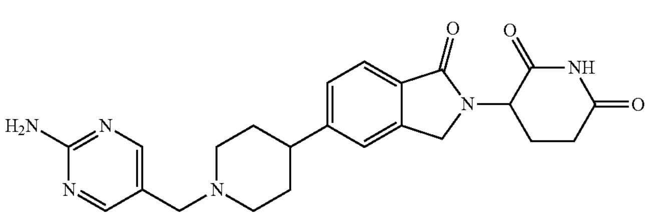 [SMILES: Nc1ncc(CN2CCC(c3ccc4c(c3)CN(C3CCC(=O)NC3=O)C4=O)CC2)cn1] | 3-(5-(1-((2-aminopyrimidin-5-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-123 | 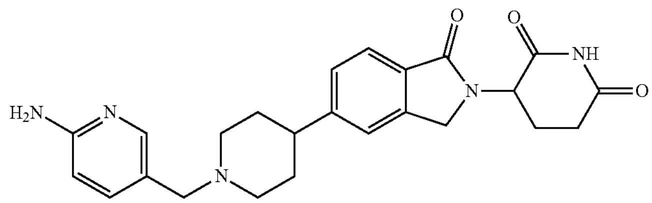 [SMILES: Nc1ccc(CN2CCC(c3ccc4c(c3)CN(C3CCC(=O)NC3=O)C4=O)CC2)cn1] | 3-(5-(1-((6-aminopyridin-3-yl)methyl)piperidin-4-yl)-1-oxoisoindolin-2-yl)piperidine-2,6-dione |
| I-124 | 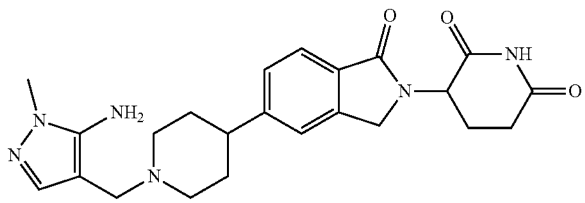 [SMILES: Cn1ncc(CN2CCC(c3ccc4c(c3)CN(C3CCC(=O)NC3=O)C4=O)CC2)c1N] | 3-(5-(1-((5-amino-1-methyl-1H-pyrazol-4-yl)methyl)piperidin-4-yl)-1-oxoisoindolin-2-yl)piperidine-2,6-dione |
| I-125 | 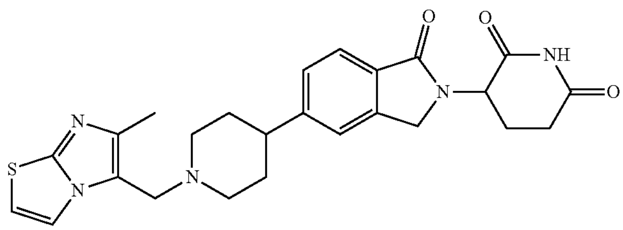 [SMILES: Cc1nc2sccn2c1CN1CCC(c2ccc3c(c2)CN(C2CCC(=O)NC2=O)C3=O)CC1] | 3-(5-(1-((6-methylimidazo[2,1-b]thiazol-5-yl)methyl)piperidin-4-yl)-1-oxoisoindolin-2-yl)piperidine-2,6-dione |
| I-126 | 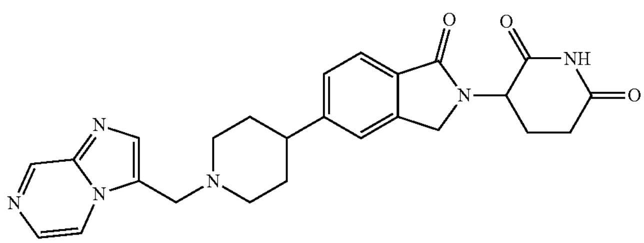 [SMILES: O=C1CCC(N2Cc3cc(C4CCN(Cc5cnc6cnccn56)CC4)ccc3C2=O)C(=O)N1] | 3-(5-(1-(imidazo[1,2-a]pyrazin-3-ylmethyl)piperidin-4-yl)-1-oxoisoindolin-2-yl)piperidine-2,6-dione |
| I-127 | 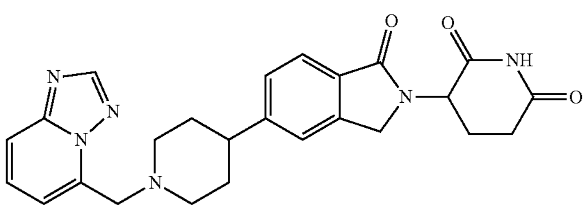 [SMILES: O=C1CCC(N2Cc3cc(C4CCN(Cc5cccc6ncnn56)CC4)ccc3C2=O)C(=O)N1] | 3-(5-(1-([1,2,4]triazolo[1,5-a]pyridin-5-ylmethyl)piperidin-4-yl)-1-oxoisoindolin-2-yl)piperidine-2,6-dione |
| I-128 | 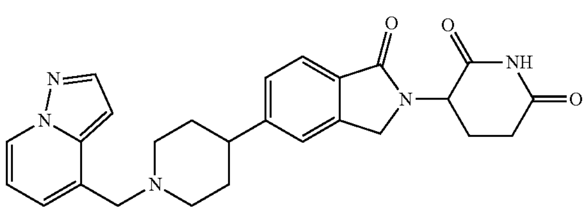 [SMILES: O=C1CCC(N2Cc3cc(C4CCN(Cc5cccn6nccc56)CC4)ccc3C2=O)C(=O)N1] | 3-(1-oxo-5-(1-(pyrazolo[1,5-a]pyridin-4-ylmethyl)piperidin-4-yl)isoindolin-2-yl)piperidine-2,6-dione |
| I-129 | 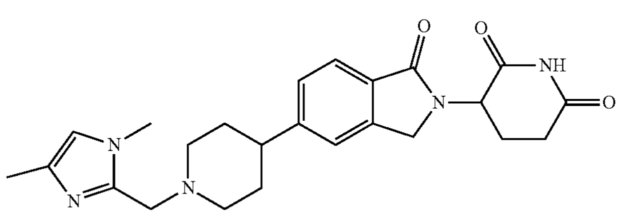 [SMILES: Cc1cn(C)c(CN2CCC(c3ccc4c(c3)CN(C3CCC(=O)NC3=O)C4=O)CC2)n1] | 3-(5-(1-((1,4-dimethyl-1H-imidazol-2-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-130 | 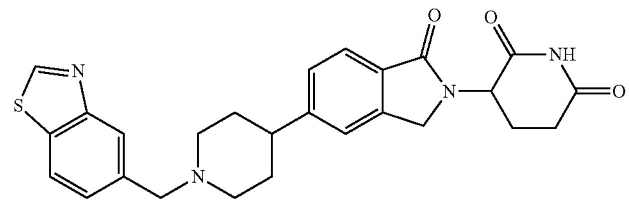 [SMILES: O=C1CCC(N2Cc3cc(C4CCN(Cc5ccc6scnc6c5)CC4)ccc3C2=O)C(=O)N1] | 3-(5-(1-(benzo[d]thiazol-5-ylmethyl)piperidin-4-yl)-1-oxoisoindolin-2-yl)piperidine-2,6-dione |
| I-131 | 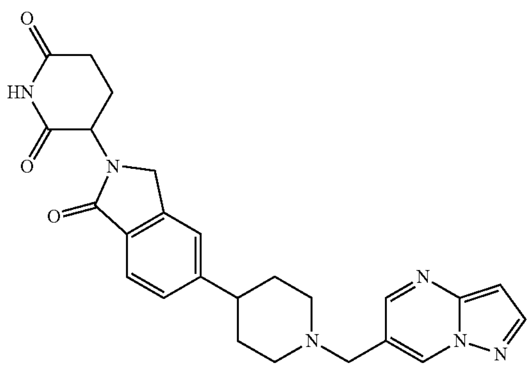 [SMILES: O=C1CCC(N2Cc3cc(C4CCN(Cc5cnc6ccnn6c5)CC4)ccc3C2=O)C(=O)N1] | 3-(1-oxo-5-(1-(pyrazolo[1,5-a]pyrimidin-6-ylmethyl)piperidin-4-yl)isoindolin-2-yl)piperidine-2,6-dione |
| I-132 | 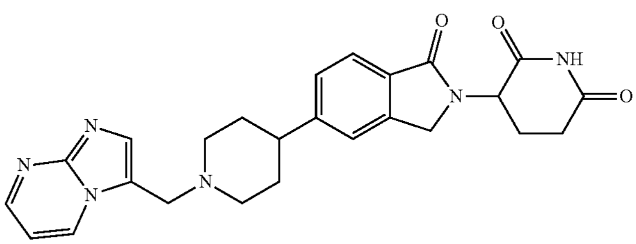 [SMILES: O=C1CCC(N2Cc3cc(C4CCN(Cc5cnc6ncccn56)CC4)ccc3C2=O)C(=O)N1] | 3-(5-(1-(imidazo[1,2-a]pyrimidin-3-ylmethyl)piperidin-4-yl)-1-oxoisoindolin-2-yl)piperidine-2,6-dione |
| I-133 | 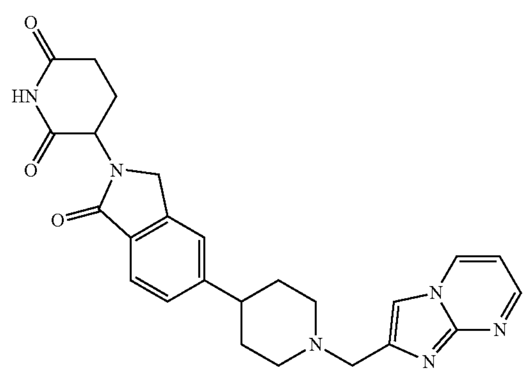 [SMILES: O=C1CCC(N2Cc3cc(C4CCN(Cc5cn6cccnc6n5)CC4)ccc3C2=O)C(=O)N1] | 3-(5-(1-(imidazo[1,2-a]pyrimidin-2-ylmethyl)piperidin-4-yl)-1-oxoisoindolin-2-yl)piperidine-2,6-dione |
| I-134 | 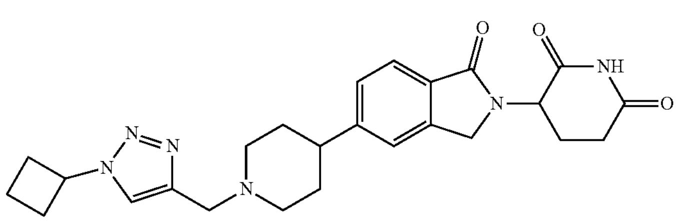 [SMILES: O=C1CCC(N2Cc3cc(C4CCN(Cc5cn(C6CCC6)nn5)CC4)ccc3C2=O)C(=O)N1] | 3-(5-(1-((1-cyclobutyl-1H-1,2,3-triazol-4-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-135 | 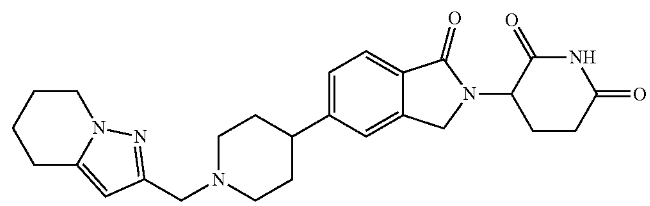 [SMILES: O=C1CCC(N2Cc3cc(C4CCN(Cc5cc6n(n5)CCCC6)CC4)ccc3C2=O)C(=O)N1] | 3-(1-oxo-5-(1-((4,5,6,7-tetra-hydropyrazolo[1,5-a]pyridin-2-yl)methyl)piperidin-4-yl)isoindolin-2-yl)piperidine-2,6-dione |
| I-136 | 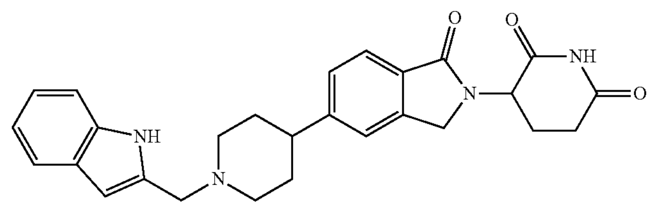 [SMILES: O=C1CCC(N2Cc3cc(C4CCN(Cc5cc6ccccc6[nH]5)CC4)ccc3C2=O)C(=O)N1] | 3-(5-(1-((1H-indol-2-yl)methyl)piperidin-4-yl)-1-oxoisoindolin-2-yl)piperidine-2,6-dione |
| I-137 | 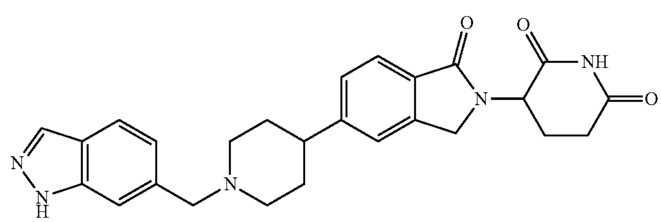 [SMILES: O=C1CCC(N2Cc3cc(C4CCN(Cc5ccc6cn[nH]c6c5)CC4)ccc3C2=O)C(=O)N1] | 3-(5-(1-((1H-indazol-6-yl)methyl)piperidin-4-yl)-1-oxoisoindolin-2-yl)piperidine-2,6-dione |
| I-138 | 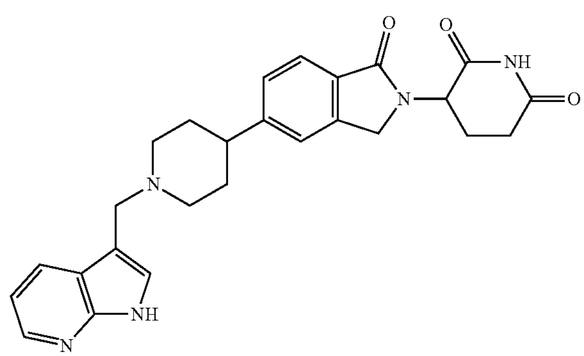 [SMILES: O=C1CCC(N2Cc3cc(C4CCN(Cc5c[nH]c6ncccc56)CC4)ccc3C2=O)C(=O)N1] | 3-(5-(1-((1H-pyrrolo[2,3-b]pyridin-3-yl)methyl)piperidin-4-yl)-1-oxoisoindolin-2-yl)piperidine-2,6-dione |
| I-139 | 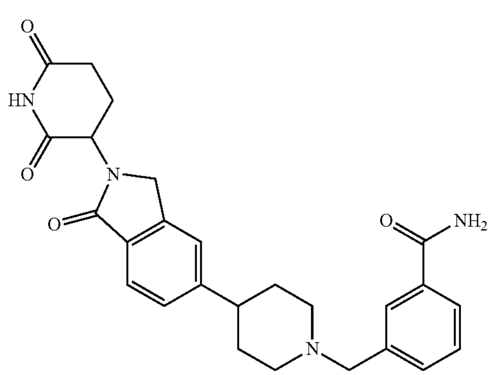 [SMILES: NC(=O)c1cccc(CN2CCC(c3ccc4c(c3)CN(C3CCC(=O)NC3=O)C4=O)CC2)c1] | 3-((4-(2-(2,6-dioxopiperidin-3-yl)-1-oxoisoindolin-5-yl)piperidin-1-yl)methyl)benzamide |

TABLE 29-continued

Exemplary degradation compounds

| Cmpd No. | Structure | Compound Name |
|---|---|---|
| I-140 | 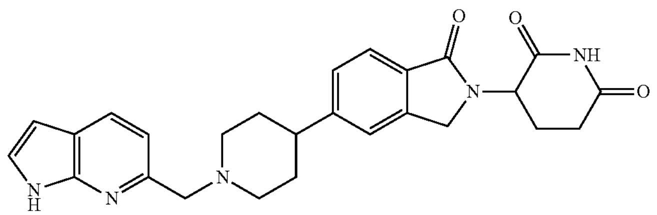 [SMILES: O=C1CCC(N2Cc3cc(C4CCN(Cc5ccc6cc[nH]c6n5)CC4)ccc3C2=O)C(=O)N1] | 3-(5-(1-((1H-pyrrolo[2,3-b]pyridin-6-yl)methyl)piperidin-4-yl)-1-oxoisoindolin-2-yl)piperidine-2,6-dione |
| I-141 | 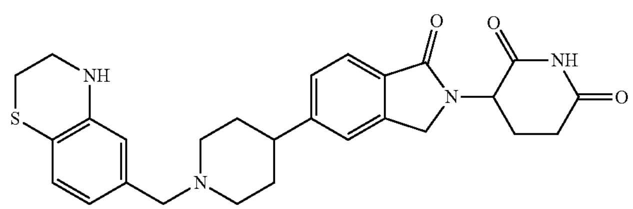 [SMILES: O=C1CCC(N2Cc3cc(C4CCN(Cc5ccc6c(c5)NCCS6)CC4)ccc3C2=O)C(=O)N1] | 3-(5-(1-((3,4-dihydro-2H-benzo[b][1,4]thiazin-6-yl)methyl)piperidin-4-yl)-1-oxoisoindolin-2-yl)piperidine-2,6-dione |
| I-142 | 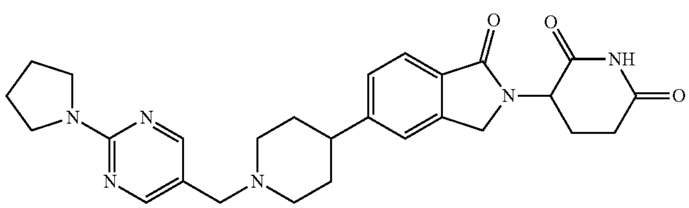 [SMILES: O=C1CCC(N2Cc3cc(C4CCN(Cc5cnc(N6CCCC6)nc5)CC4)ccc3C2=O)C(=O)N1] | 3-(1-oxo-5-(1-((2-(pyrrolidin-1-yl)pyrimidin-5-yl)methyl)piperidin-4-yl)isoindolin-2-yl)piperidine-2,6-dione |
| I-143 | 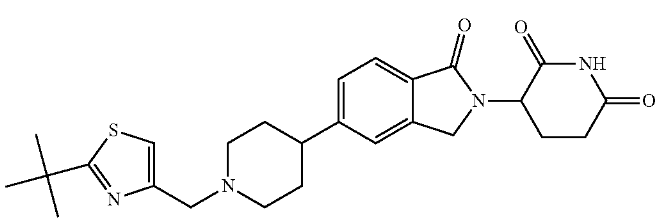 [SMILES: CC(C)(C)c1nc(CN2CCC(c3ccc4c(c3)CN(C3CCC(=O)NC3=O)C4=O)CC2)cs1] | 3-(5-(1-((2-(tert-butyl)thiazol-4-yl)methyl)piperidin-4-yl)-1-oxoisoindolin-2-yl)piperidine-2,6-dione |
| I-144 | 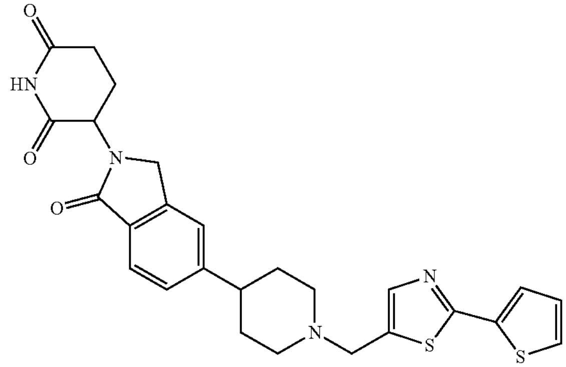 [SMILES: O=C1CCC(N2Cc3cc(C4CCN(Cc5cnc(-c6cccs6)s5)CC4)ccc3C2=O)C(=O)N1] | 3-(1-oxo-5-(1-((2-(thiophen-2-yl)thiazol-5-yl)methyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-145 | 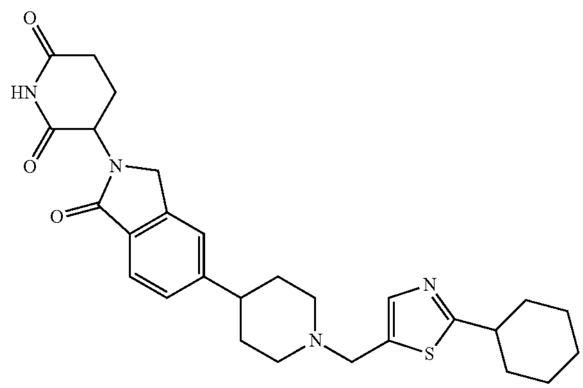 [SMILES: O=C1CCC(N2Cc3cc(C4CCN(Cc5cnc(C6CCCCC6)s5)CC4)ccc3C2=O)C(=O)N1] | 3-(5-(1-((2-cyclo-hexylthiazol-5-yl)methyl)piperidin-4-yl)-1-oxoiso-indolin-2-yl)piperidine-2,6-dione |
| I-146 | 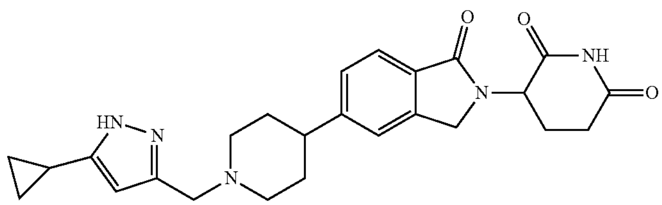 [SMILES: O=C1CCC(N2Cc3cc(C4CCN(Cc5cc(C6CC6)[nH]n5)CC4)ccc3C2=O)C(=O)N1] | 3-(5-(1-((5-cyclopropyl-1H-pyrazol-3-yl)methyl)piperidin-4-yl)-1-oxoisoindolin-2-yl)piperidine-2,6-dione |
| I-147 | 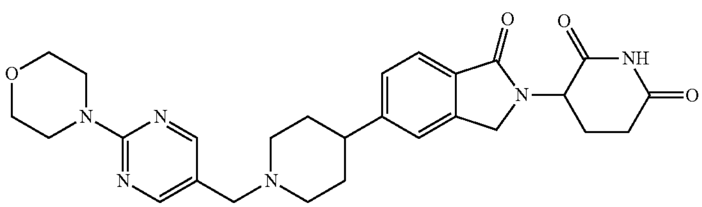 [SMILES: O=C1CCC(N2Cc3cc(C4CCN(Cc5cnc(N6CCOCC6)nc5)CC4)ccc3C2=O)C(=O)N1] | 3-(5-(1-((2-morpholino-pyrimidin-5-yl)methyl)piperidin-4-yl)-1-oxoiso-indolin-2-yl)piperidine-2,6-dione |
| I-148 | 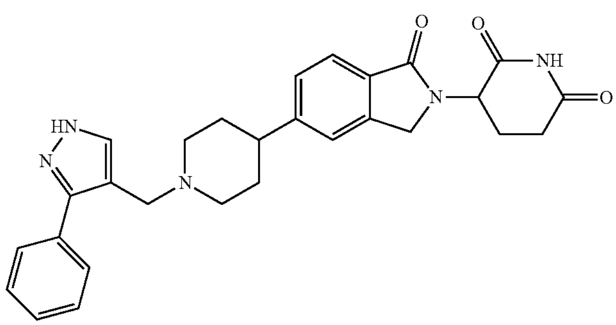 [SMILES: O=C1CCC(N2Cc3cc(C4CCN(Cc5c[nH]nc5-c5ccccc5)CC4)ccc3C2=O)C(=O)N1] | 3-(1-oxo-5-(1-((3-phenyl-1H-pyrazol-4-yl)methyl)piperidin-4-yl)isoindolin-2-yl)piperidine-2,6-dione |
| I-149 | 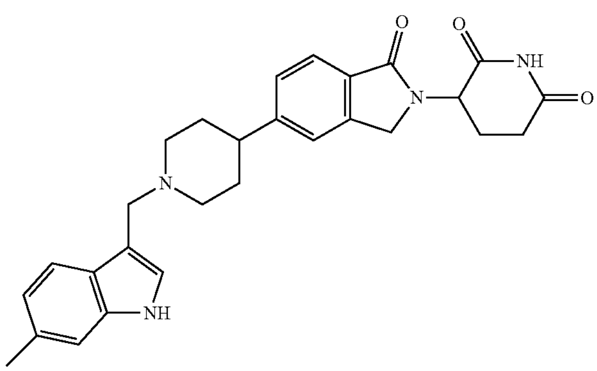 [SMILES: Cc1ccc2c(CN3CCC(c4ccc5c(c4)CN(C4CCC(=O)NC4=O)C5=O)CC3)c[nH]c2c1] | 3-(5-(1-((6-methyl-1H-indol-3-yl)methyl)piperidin-4-yl)-1-oxoiso-indolin-2-yl)piperidine-2,6-dione |

TABLE 29-continued

Exemplary degradation compounds

| Cmpd No. | Structure | Compound Name |
|---|---|---|
| I-150 | 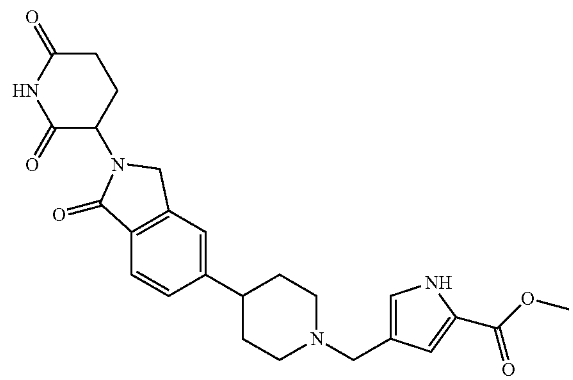 [SMILES: COC(=O)c1cc(CN2CCC(c3ccc4c(c3)CN(C3CCC(=O)NC3=O)C4=O)CC2)c[nH]1] | methyl 4-((4-(2-(2,6-dioxo-piperidin-3-yl)-1-oxoisoindolin-5-yl)piperidin-1-yl)methyl)-1H-pyrrole-2-carboxylate |
| I-151 | 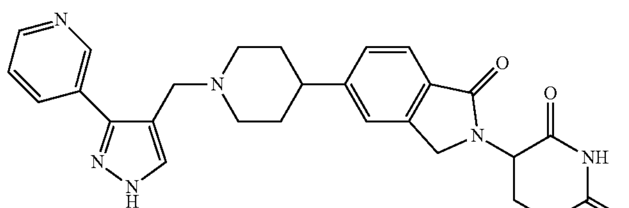 | 3-(1-oxo-5-(1-((3-(pyridin-3-yl)-1H-pyrazol-4-yl)methyl)piperidin-4-yl)isoindolin-2-yl)piperidine-2,6-dione |
| I-152 | 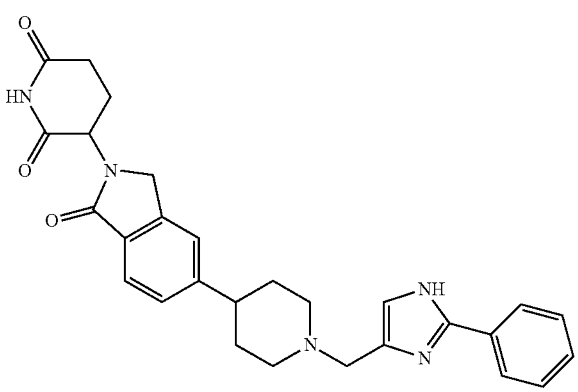 [SMILES: O=C1CCC(N2Cc3cc(C4CCN(Cc5c[nH]c(-c6ccccc6)n5)CC4)ccc3C2=O)C(=O)N1] | 3-(1-oxo-5-(1-((2-phenyl-1H-imidazol-4-yl)methyl)piperidin-4-yl)isoindolin-2-yl)piperidine-2,6-dione |
| I-153 | 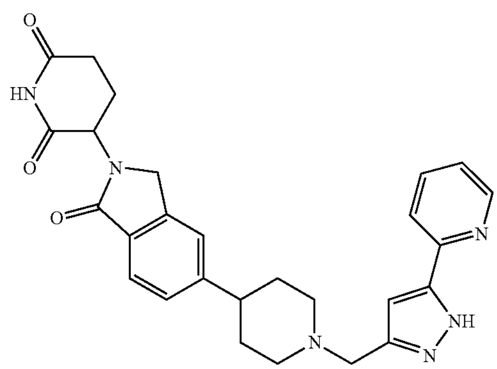 [SMILES: O=C1CCC(N2Cc3cc(C4CCN(Cc5cc(-c6ccccn6)[nH]n5)CC4)ccc3C2=O)C(=O)N1] | 3-(1-oxo-5-(1-((5-(pyridin-2-yl)-1H-pyrazol-3-yl)methyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-154 | 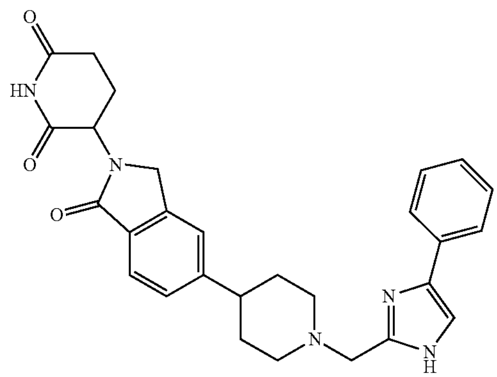 [SMILES: O=C1CCC(N2Cc3cc(C4CCN(Cc5nc(-c6ccccc6)c[nH]5)CC4)ccc3C2=O)C(=O)N1] | 3-(1-oxo-5-(1-((4-phenyl-1H-imidazol-2-yl)methyl)piperidin-4-yl)isoindolin-2-yl)piperidine-2,6-dione |
| I-155 | 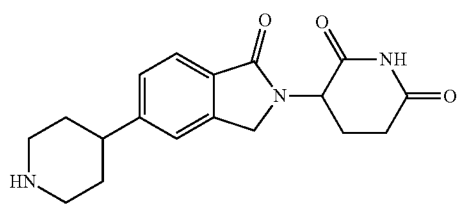 [SMILES: O=C1CCC(N2Cc3cc(C4CCNCC4)ccc3C2=O)C(=O)N1] | 3-(1-oxo-5-(piperidin-4-yl)isoindolin-2-yl)piperidine-2,6-dione |
| I-156 | 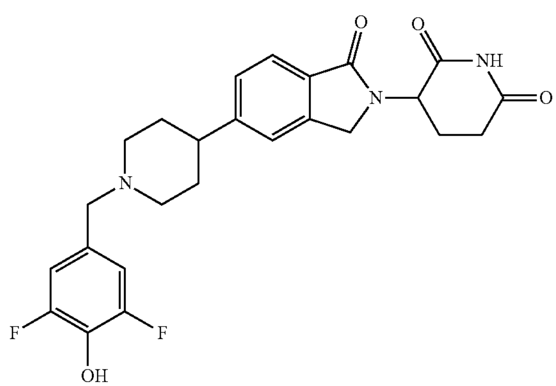 [SMILES: O=C1CCC(N2Cc3cc(C4CCN(Cc5cc(F)c(O)c(F)c5)CC4)ccc3C2=O)C(=O)N1] | 3-(5-(1-(3,5-difluoro-4-hydroxybenzyl)piperidin-4-yl)-1-oxoisoindolin-2-yl)piperidine-2,6-dione |
| I-157 | 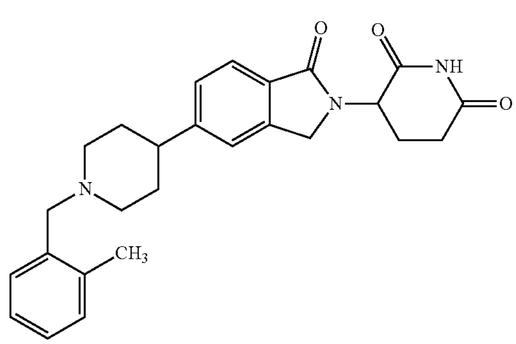 [SMILES: Cc1ccccc1CN1CCC(c2ccc3c(c2)CN(C2CCC(=O)NC2=O)C3=O)CC1] | 3-(5-(1-(2-methylbenzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-158 | 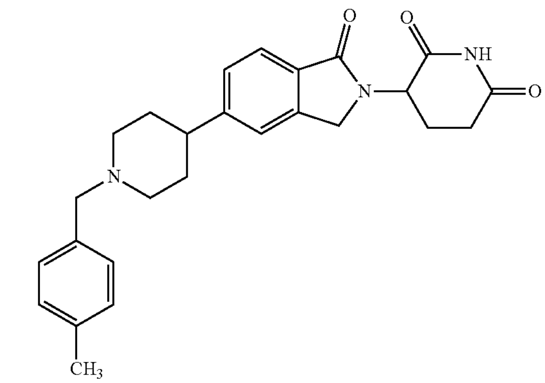 [SMILES: Cc1ccc(CN2CCC(c3ccc4c(c3)CN(C3CCC(=O)NC3=O)C4=O)CC2)cc1] | 3-(5-(1-(4-methylbenzyl)piperidin-4-yl)-1-oxoisoindolin-2-yl)piperidine-2,6-dione |
| I-159 | 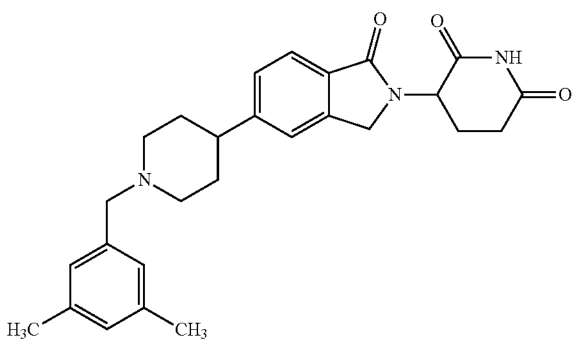 [SMILES: Cc1cc(C)cc(CN2CCC(c3ccc4c(c3)CN(C3CCC(=O)NC3=O)C4=O)CC2)c1] | 3-(5-(1-(3,5-dimethylbenzyl)piperidin-4-yl)-1-oxoisoindolin-2-yl)piperidine-2,6-dione |
| I-160 | 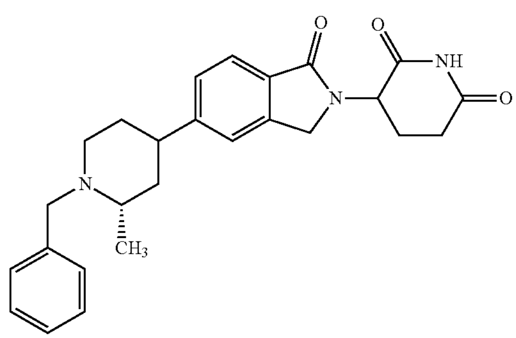 [SMILES: C[C@H]1CC(c2ccc3c(c2)CN(C2CCC(=O)NC2=O)C3=O)CCN1Cc1ccccc1] | 3-(5-((2S)-1-benzyl-2-methylpiperidin-4-yl)-1-oxoisoindolin-2-yl)piperidine-2,6-dione |
| I-161 | 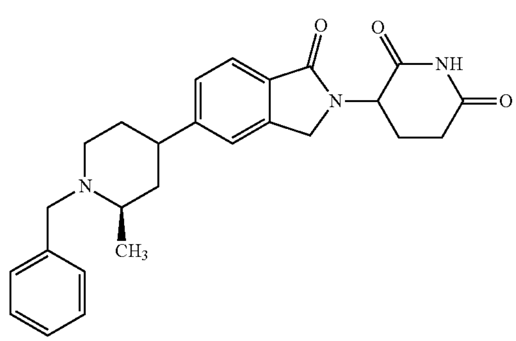 [SMILES: C[C@@H]1CC(c2ccc3c(c2)CN(C2CCC(=O)NC2=O)C3=O)CCN1Cc1ccccc1] | 3-(5-((2R)-1-benzyl-2-methylpiperidin-4-yl)-1-oxoisoindolin-2-yl)piperidine-2,6-dione |

TABLE 29-continued

Exemplary degradation compounds

| Cmpd No. | Structure | Compound Name |
| --- | --- | --- |
| I-162 | 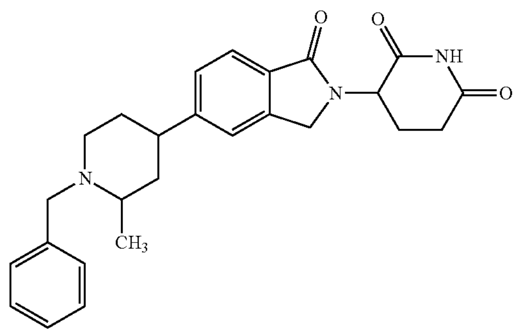 [SMILES: CC1CC(c2ccc3c(c2)CN(C2CCC(=O)NC2=O)C3=O)CCN1Cc1ccccc1] | 3-(5-(1-benzyl-2-methylpiperidin-4-yl)-1-oxoisoindolin-2-yl)piperidine-2,6-dione |
| I-163 | 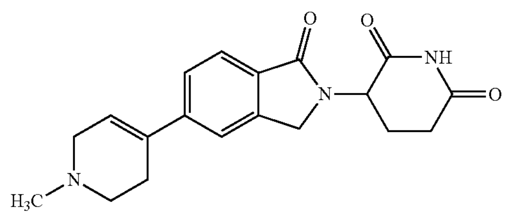 [SMILES: CN1CC=C(c2ccc3c(c2)CN(C2CCC(=O)NC2=O)C3=O)CC1] | 3-(5-(1-methyl-1,2,3,6-tetrahydropyridin-4-yl)-1-oxoisoindolin-2-yl)piperidine-2,6-dione |
| I-164 | 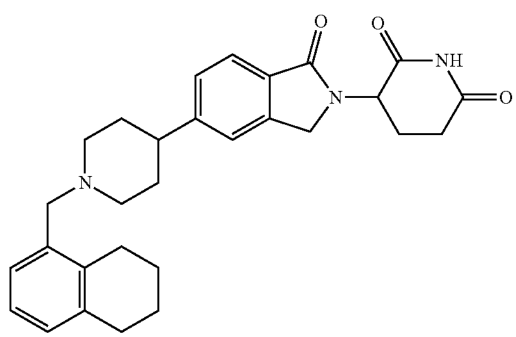 [SMILES: O=C1CCC(N2Cc3cc(C4CCN(Cc5cccc6c5CCCC6)CC4)ccc3C2=O)C(=O)N1] | 3-(1-oxo-5-(1-((5,6,7,8-tetrahydronaphthalen-1-yl)methyl)piperidin-4-yl)isoindolin-2-yl)piperidine-2,6-dione |
| I-165 | 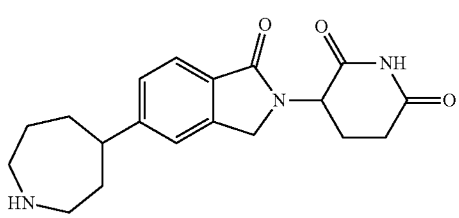 [SMILES: O=C1CCC(N2Cc3cc(C4CCCNCC4)ccc3C2=O)C(=O)N1] | 3-(5-(azepan-4-yl)-1-oxoisoindolin-2-yl)piperidine-2,6-dione |
| I-166 | 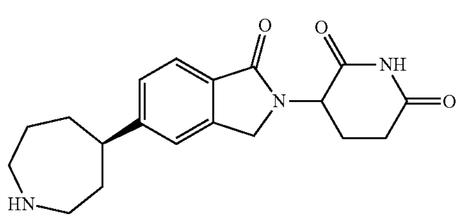 [SMILES: O=C1CCC(N2Cc3cc([C@@H]4CCCNCC4)ccc3C2=O)C(=O)N1] | 3-(5-((R)-azepan-4-yl)-1-oxoisoindolin-2-yl)piperidine-2,6-dione |
| I-167 | 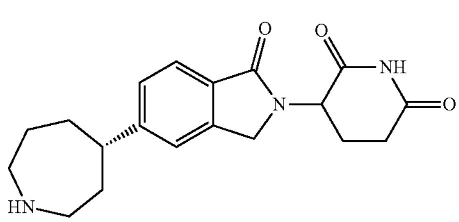 [SMILES: O=C1CCC(N2Cc3cc([C@H]4CCCNCC4)ccc3C2=O)C(=O)N1] | 3-(5-((S)-azepan-4-yl)-1-oxoisoindolin-2-yl)piperidine-2,6-dione |

TABLE 29-continued

Exemplary degradation compounds

| Cmpd No. | Structure | Compound Name |
|---|---|---|
| I-168 | 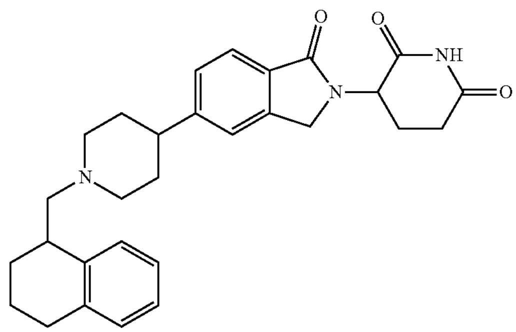 [SMILES: O=C1CCC(N2Cc3cc(C4CCN(CC5CCCc6ccccc65)CC4)ccc3C2=O)C(=O)N1] | 3-(1-oxo-5-(1-(((1,2,3,4-tetra-hydronaphthalen-1-yl)methyl) piperidin-4-yl) isoindolin-2-yl) piperidine-2,6-dione |
| I-169 | 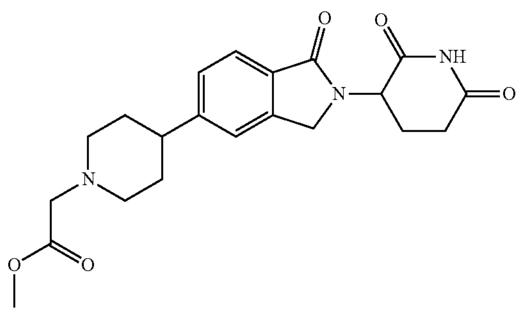 [SMILES: COC(=O)CN1CCC(c2ccc3c(c2)CN(C2CCC(=O)NC2=O)C3=O)CC1] | methyl 2-(4-(2-(2,6-dioxo-piperidin-3-yl)-1-oxoisoindolin-5-yl) piperidin-1-yl) acetate |
| I-170 | 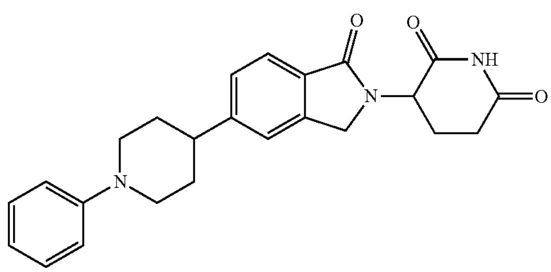 [SMILES: O=C1CCC(N2Cc3cc(C4CCN(c5ccccc5)CC4)ccc3C2=O)C(=O)N1] | 3-(1-oxo-5-(1-phenylpiperidin-4-yl)isoindolin-2-yl)piperidine-2,6-dione |
| I-171 | 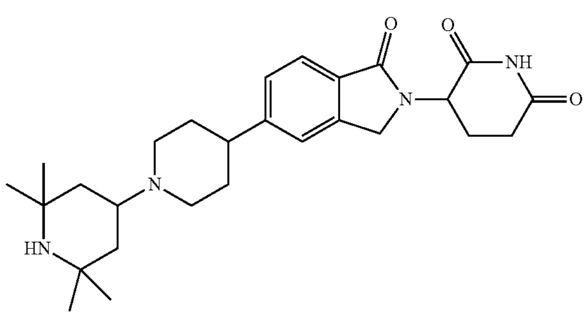 [SMILES: CC1(C)CC(N2CCC(c3ccc4c(c3)CN(C3CCC(=O)NC3=O)C4=O)CC2)CC(C)(C)N1] | 3-(1-oxo-5-(2,2,6,6-tetramethyl-piperidin-4-yl) isoindolin-2-yl) piperidine-2,6-dione |
| I-172 | 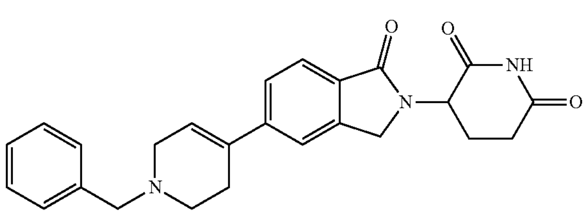 [SMILES: O=C1CCC(N2Cc3cc(C4=CCN(Cc5ccccc5)CC4)ccc3C2=O)C(=O)N1] | 3-(5-(1-benzyl-1,2,3,6-tetra-hydropyridin-4-yl)-1-oxo-isoindolin-2-yl) piperidine-2,6-dione |

TABLE 29-continued

Exemplary degradation compounds

| Cmpd No. | Structure | Compound Name |
|---|---|---|
| I-173 | 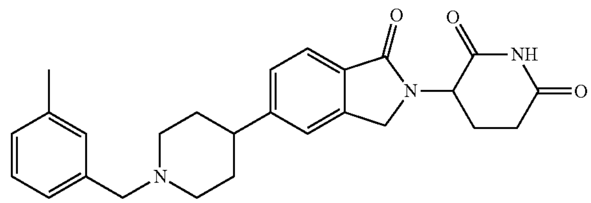 [SMILES: Cc1cccc(CN2CCC(c3ccc4c(c3)CN(C3CCC(=O)NC3=O)C4=O)CC2)c1] | 3-(5-(1-(3-methylbenzyl)piperidin-4-yl)-1-oxoisoindolin-2-yl)piperidine-2,6-dione |
| I-174 | 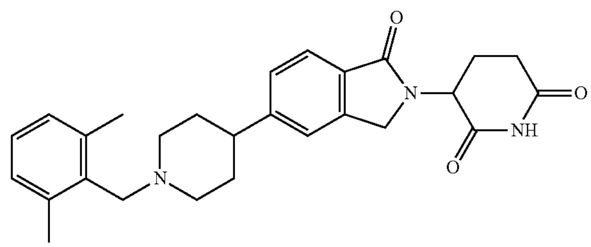 [SMILES: Cc1cccc(C)c1CN1CCC(c2ccc3c(c2)CN(C2CCC(=O)NC2=O)C3=O)CC1] | 3-(5-(1-(2,6-dimethylbenzyl)piperidin-4-yl)-1-oxoisoindolin-2-yl)piperidine-2,6-dione |
| I-175 | 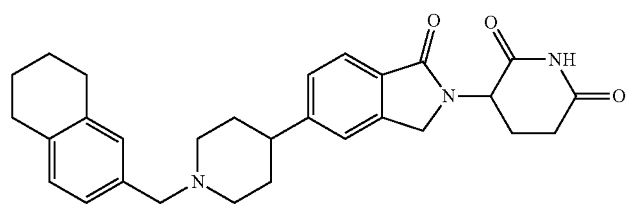 [SMILES: O=C1CCC(N2Cc3cc(C4CCN(Cc5ccc6c(c5)CCCC6)CC4)ccc3C2=O)C(=O)N1] | 3-(1-oxo-5-(1-((5,6,7,8-tetrahydronaphthalen-2-yl)methyl)piperidin-4-yl)isoindolin-2-yl)piperidine-2,6-dione |
| I-176 | 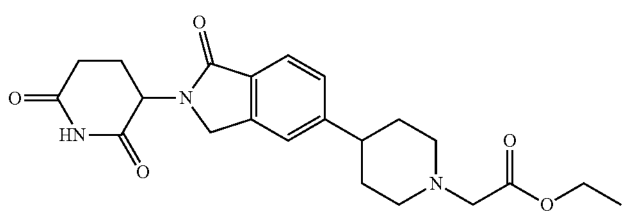 [SMILES: CCOC(=O)CN1CCC(c2ccc3c(c2)CN(C2CCC(=O)NC2=O)C3=O)CC1] | ethyl 2-(4-(2-(2,6-dioxopiperidin-3-yl)-1-oxoisoindolin-5-yl)piperidin-1-yl)acetate |
| I-177 | 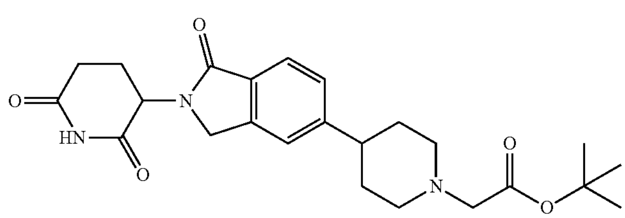 [SMILES: CC(C)(C)OC(=O)CN1CCC(c2ccc3c(c2)CN(C2CCC(=O)NC2=O)C3=O)CC1] | tert-butyl 2-(4-(2-(2,6-dioxopiperidin-3-yl)-1-oxoisoindolin-5-yl)piperidin-1-yl)acetate |
| I-178 | 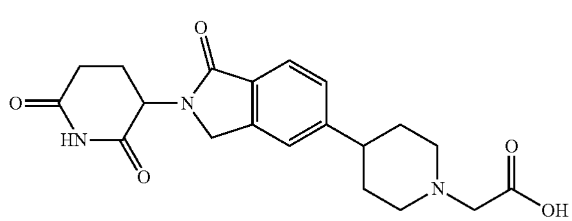 [SMILES: O=C(O)CN1CCC(c2ccc3c(c2)CN(C2CCC(=O)NC2=O)C3=O)CC1] | 2-(4-(2-(2,6-dioxopiperidin-3-yl)-1-oxoisoindolin-5-yl)piperidin-1-yl)acetic acid |

TABLE 29-continued

Exemplary degradation compounds

| Cmpd No. | Structure | Compound Name |
|---|---|---|
| I-179 | 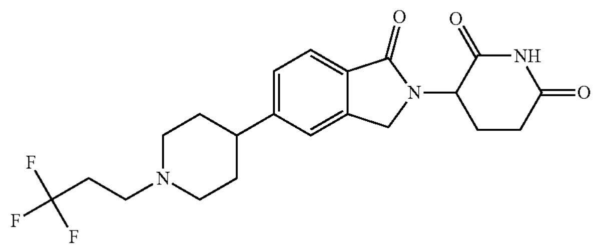 [SMILES: O=C1CCC(N2Cc3cc(C4CCN(CCC(F)(F)F)CC4)ccc3C2=O)C(=O)N1] | 3-(1-oxo-5-(1-(3,3,3-trifluoro-propyl)piperidin-4-yl)isoindolin-2-yl)piperidine-2,6-dione |
| I-180 | 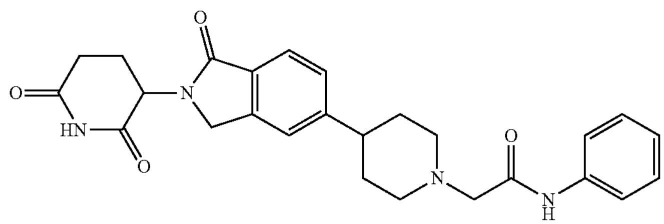 [SMILES: O=C1CCC(N2Cc3cc(C4CCN(CC(=O)Nc5ccccc5)CC4)ccc3C2=O)C(=O)N1] | 2-(4-(2-(2,6-dioxopiperidin-3-yl)-1-oxo-isoindolin-5-yl)piperidin-1-yl)-N-phenylacetamide |
| I-181 | 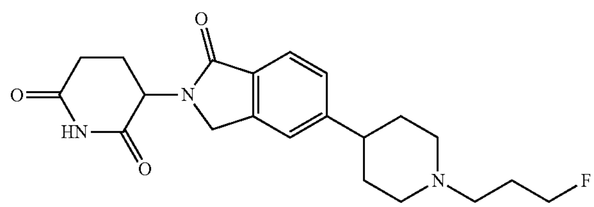 [SMILES: O=C1CCC(N2Cc3cc(C4CCN(CCCF)CC4)ccc3C2=O)C(=O)N1] | 3-(5-(1-(3-fluoropropyl)piperidin-4-yl)-1-oxoisoindolin-2-yl)piperidine-2,6-dione |
| I-182 | 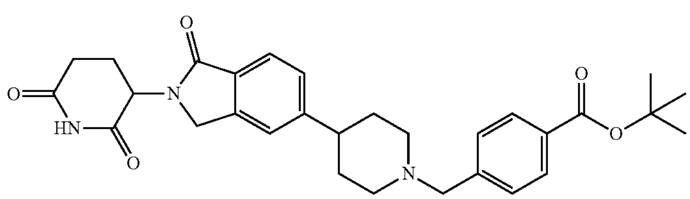 [SMILES: CC(C)(C)OC(=O)c1ccc(CN2CCC(c3ccc4c(c3)CN(C3CCC(=O)NC3=O)C4=O)CC2)cc1] | tert-butyl 4-((4-(2-(2,6-dioxo-piperidin-3-yl)-1-oxoisoindolin-5-yl)piperidin-1-yl)methyl)benzoate |
| I-183 | 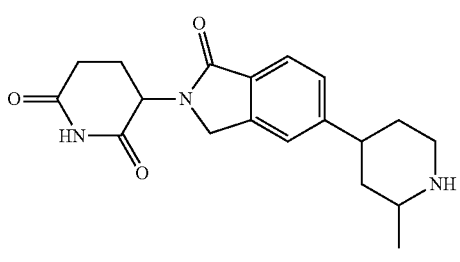 [SMILES: CC1CC(c2ccc3c(c2)CN(C2CCC(=O)NC2=O)C3=O)CCN1] | 3-(5-(2-methyl-piperidin-4-yl)-1-oxoisoindolin-2-yl)piperidine-2,6-dione |
| I-184 | 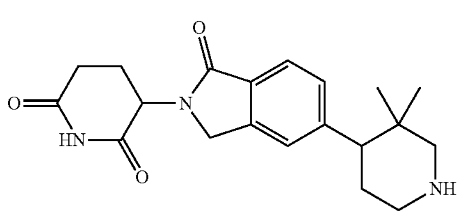 [SMILES: CC1(C)CNCCC1c1ccc2c(c1)CN(C1CCC(=O)NC1=O)C2=O] | 3-(5-(3,3-dimethyl-piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-185 | 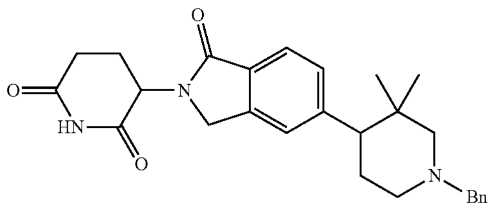 [SMILES: CC1(C)CN(Cc2ccccc2)CCC1c1ccc2c(c1)CN(C1CCC(=O)NC1=O)C2=O] | 3-(5-(1-benzyl-3,3-dimethylpiperidin-4-yl)-1-oxoisoindolin-2-yl)piperidine-2,6-dione |
| I-186 | 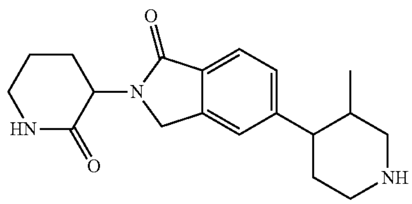 [SMILES: CC1CNCCC1c1ccc2c(c1)CN(C1CCCNC1=O)C2=O] | 5-(3-methylpiperidin-4-yl)-2-(2-oxopiperidin-3-yl)isoindolin-1-one |
| I-187 | 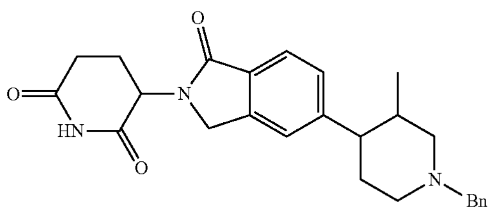 [SMILES: CC1CN(Cc2ccccc2)CCC1c1ccc2c(c1)CN(C1CCC(=O)NC1=O)C2=O] | 3-(5-(1-benzyl-3-methylpiperidin-4-yl)-1-oxoisoindolin-2-yl)piperidine-2,6-dione |
| I-188 | 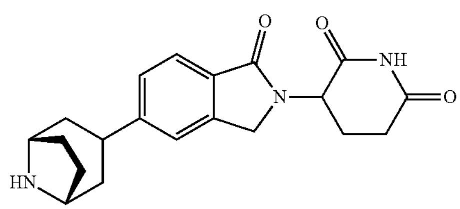 | 3-(5-(8-azabicyclo[3.2.1]octan-3-yl)-1-oxoisoindolin-2-yl)piperidine-2,6-dione |
| I-189 | 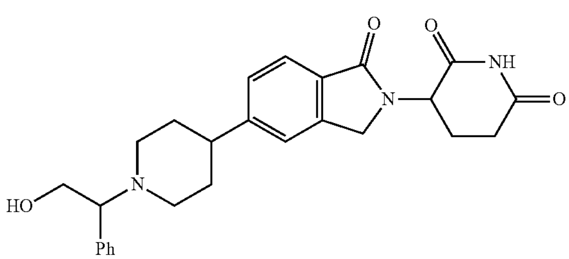 [SMILES: O=C1CCC(N2Cc3cc(C4CCN(C(CO)c5ccccc5)CC4)ccc3C2=O)C(=O)N1] | 3-(5-(1-(2-hydroxy-1-phenylethyl)piperidin-4-yl)-1-oxoisoindolin-2-yl)piperidine-2,6-dione |
| I-190 | 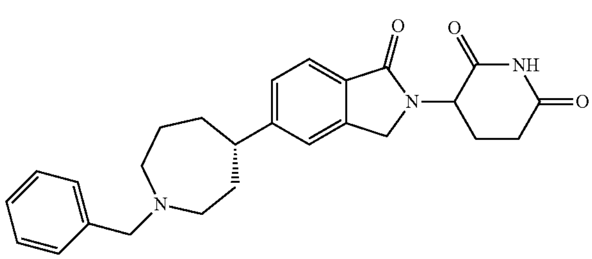 [SMILES: O=C1CCC(N2Cc3cc([C@H]4CCCN(Cc5ccccc5)CC4)ccc3C2=O)C(=O)N1] | 3-(5-((S)-1-benzylazepan-4-yl)-1-oxoisoindolin-2-yl)piperidine-2,6-dione |

TABLE 29-continued

Exemplary degradation compounds

| Cmpd No. | Structure | Compound Name |
|---|---|---|
| I-191 | 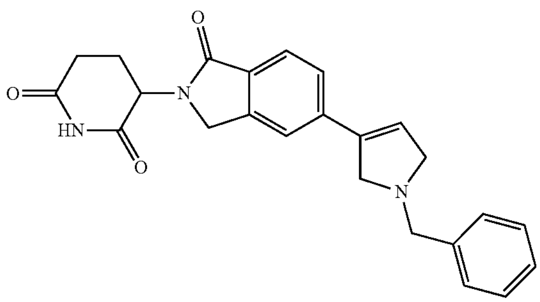 [SMILES: O=C1CCC(N2Cc3cc(C4=CCN(Cc5ccccc5)C4)ccc3C2=O)C(=O)N1] | 3-(5-(1-benzyl-2,5-dihydro-1H-pyrrol-3-yl)-1-oxoisoindolin-2-yl)piperidine-2,6-dione |
| I-192 | 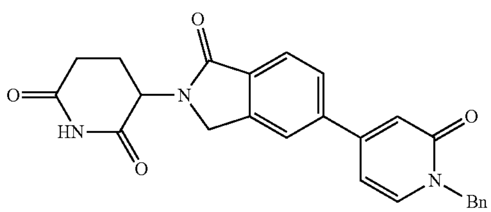 [SMILES: O=C1CCC(N2Cc3cc(-c4ccn(Cc5ccccc5)c(=O)c4)ccc3C2=O)C(=O)N1] | 3-(5-(1-benzyl-2-oxo-1,2-dihydropyridin-4-yl)-1-oxoisoindolin-2-yl)piperidine-2,6-dione |
| I-193 | 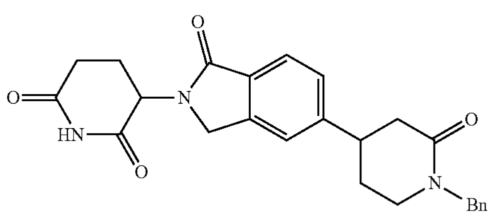 [SMILES: O=C1CCC(N2Cc3cc(C4CCN(Cc5ccccc5)C(=O)C4)ccc3C2=O)C(=O)N1] | 3-(5-(1-benzyl-2-oxopiperidin-4-yl)-1-oxoisoindolin-2-yl)piperidine-2,6-dione |
| I-194 | 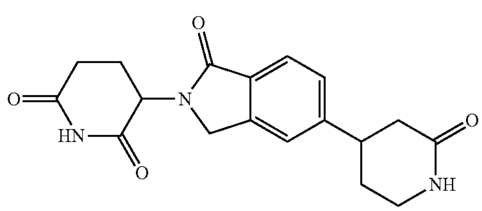 [SMILES: O=C1CC(c2ccc3c(c2)CN(C2CCC(=O)NC2=O)C3=O)CCN1] | 3-(1-oxo-5-(2-oxopiperidin-4-yl)isoindolin-2-yl)piperidine-2,6-dione |
| I-195 | 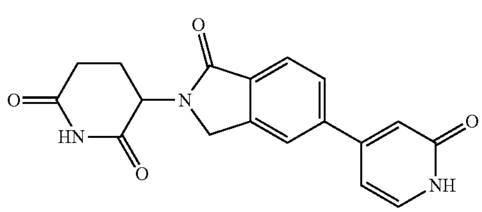 [SMILES: O=C1CCC(N2Cc3cc(-c4cc[nH]c(=O)c4)ccc3C2=O)C(=O)N1] | 3-(1-oxo-5-(2-oxo-1,2-dihydropyridin-4-yl)isoindolin-2-yl)piperidine-2,6-dione |
| I-196 | 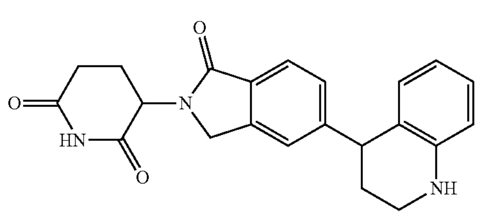 [SMILES: O=C1CCC(N2Cc3cc(C4CCNc5ccccc54)ccc3C2=O)C(=O)N1] | 3-(1-oxo-5-(1,2,3,4-tetrahydroquinolin-4-yl)isoindolin-2-yl)piperidine-2,6-dione |

TABLE 29-continued

Exemplary degradation compounds

| Cmpd No. | Structure | Compound Name |
|---|---|---|
| I-197 | 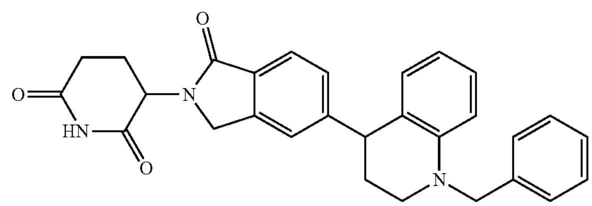 [SMILES: O=C1CCC(N2Cc3cc(C4CCN(Cc5ccccc5)c5ccccc54)ccc3C2=O)C(=O)N1] | 3-(5-(1-benzyl-1,2,3,4-tetrahydro-quinolin-4-yl)-1-oxoisoindolin-2-yl)piperidine-2,6-dione |
| I-198 | 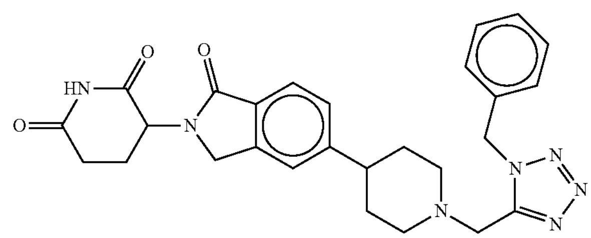 | 3-(5-(1-((1-benzyl-1H-tetrazol-5-yl)methyl)piperidin-4-yl)-1-oxoiso-indolin-2-yl)piperidine-2,6-dione |
| I-199 | 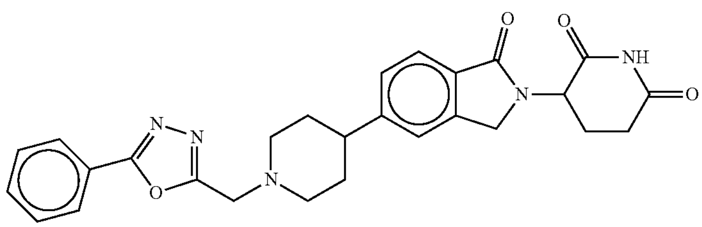 | 3-(1-oxo-5-(1-((5-phenyl-1,3,4-oxadiazol-2-yl)methyl)piperidin-4-yl)isoindolin-2-yl)piperidine-2,6-dione |
| I-200 | 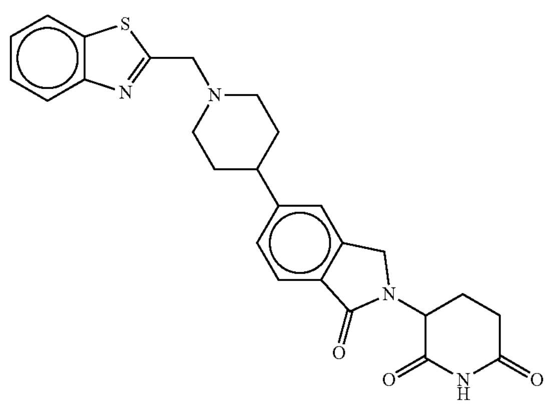 | 3-(5-(1-(benzo[d]thiazol-2-ylmethyl)piperidin-4-yl)-1-oxoiso-indolin-2-yl)piperidine-2,6-dione |
| I-201 | 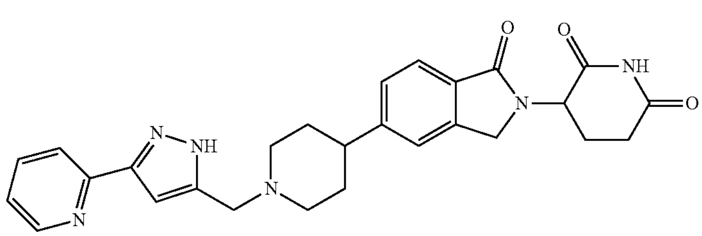 [SMILES: O=C1CCC(N2Cc3cc(C4CCN(Cc5cc(-c6ccccn6)n[nH]5)CC4)ccc3C2=O)C(=O)N1] | 3-(1-oxo-5-(1-((3-(pyridin-2-yl)-1H-pyrazol-5-yl)methyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-202 | 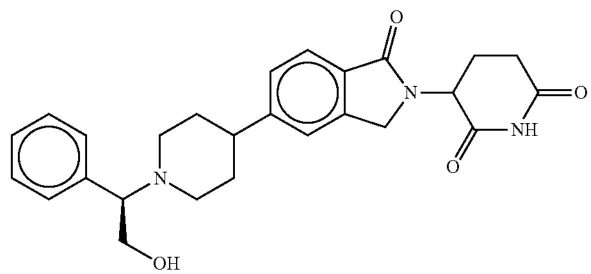 | 3-(5-(1-((R)-2-hydroxy-1-phenylethyl)piperidin-4-yl)-1-oxoisoindolin-2-yl)piperidine-2,6-dione |
| I-203 | 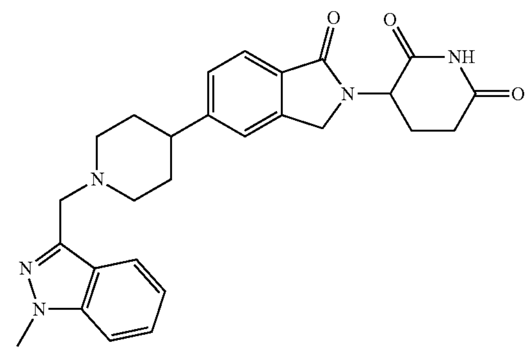 [SMILES: Cn1nc(CN2CCC(c3ccc4c(c3)CN(C3CCC(=O)NC3=O)C4=O)CC2)c2ccccc21] | 3-(5-(1-((1-methyl-1H-indazol-3-yl)methyl)piperidin-4-yl)-1-oxoisoindolin-2-yl)piperidine-2,6-dione |
| I-204 | 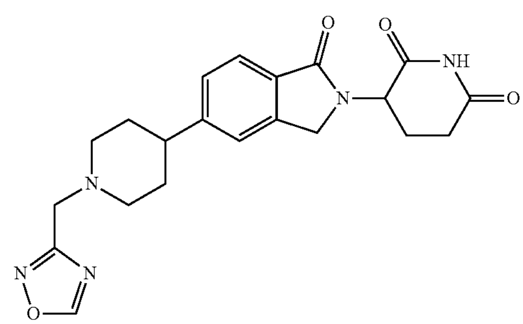 [SMILES: O=C1CCC(N2Cc3cc(C4CCN(Cc5ncon5)CC4)ccc3C2=O)C(=O)N1] | 3-(5-(1-((1,2,4-oxadiazol-3-yl)methyl)piperidin-4-yl)-1-oxoisoindolin-2-yl)piperidine-2,6-dione |
| I-205 | 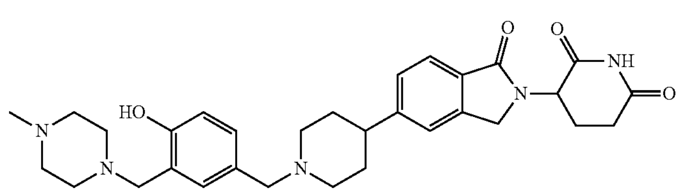 [SMILES: CN1CCN(Cc2cc(CN3CCC(c4ccc5c(c4)CN(C4CCC(=O)NC4=O)C5=O)CC3)ccc2O)CC1] | 3-(5-(1-(4-hydroxy-3-((4-methylpiperazin-1-yl)methyl)benzyl)piperidin-4-yl)-1-oxoisoindolin-2-yl)piperidine-2,6-dione |
| I-206 | 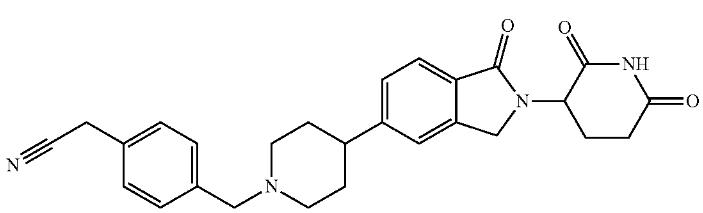 [SMILES: N#CCc1ccc(CN2CCC(c3ccc4c(c3)CN(C3CCC(=O)NC3=O)C4=O)CC2)cc1] | 2-(4-((4-(2-(2,6-dioxopiperidin-3-yl)-1-oxoisoindolin-5-yl)piperidin-1-yl)methyl)phenyl)acetonitrile |

TABLE 29-continued

Exemplary degradation compounds

| Cmpd No. | Structure | Compound Name |
|---|---|---|
| I-207 | 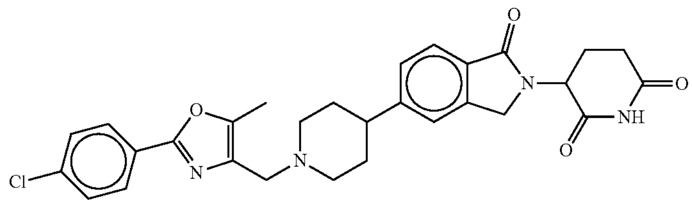 | 3-(5-(1-((2-(4-chlorophenyl)-5-methyloxazol-4-yl)methyl)piperidin-4-yl)-1-oxoisoindolin-2-yl)piperidine-2,6-dione |
| I-208 | 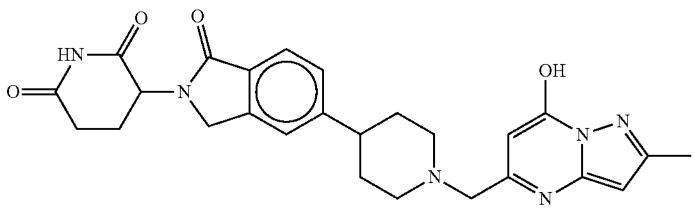 | 3-(5-(1-((7-hydroxy-2-methylpyrazolo[1,5-a]pyrimidin-5-yl)methyl)piperidin-4-yl)-1-oxoisoindolin-2-yl)piperidine-2,6-dione |
| I-209 | 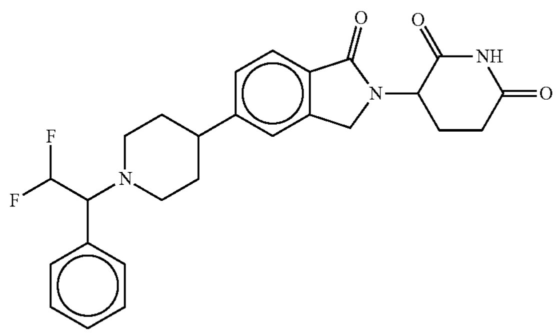 | 3-(5-(1-(2,2-difluoro-1-phenylethyl)piperidin-4-yl)-1-oxoisoindolin-2-yl)piperidine-2,6-dione |
| I-210 | 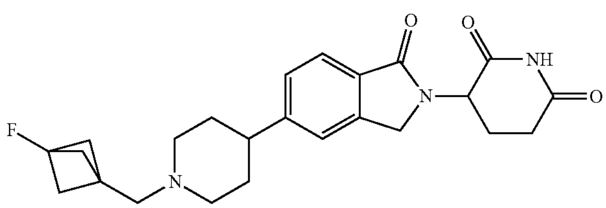 [SMILES: O=C1CCC(N2Cc3cc(C4CCN(CC56CC(F)(C5)C6)CC4)ccc3C2=O)C(=O)N1] | 3-(5-(1-((3-fluorobicyclo[1.1.1]pentan-1-yl)methyl)piperidin-4-yl)-1-oxoisoindolin-2-yl)piperidine-2,6-dione |
| I-211 | 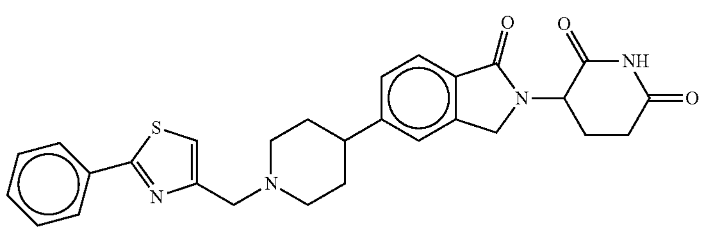 | 3-(1-oxo-5-(1-((2-phenylthiazol-4-yl)methyl)piperidin-4-yl)isoindolin-2-yl)piperidine-2,6-dione |
| I-212 | 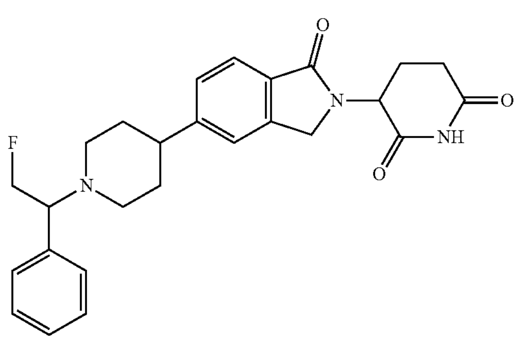 [SMILES: O=C1CCC(N2Cc3cc(C4CCN(C(CF)c5ccccc5)CC4)ccc3C2=O)C(=O)N1] | 3-(5-(1-(2-fluoro-1-phenylethyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-213 | 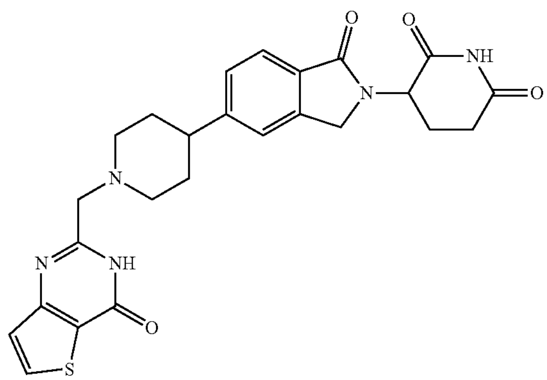 [SMILES: O=C1CCC(N2Cc3cc(C4CCN(Cc5nc6ccsc6c(=O)[nH]5)CC4)ccc3C2=O)C(=O)N1] | 3-(1-oxo-5-(1-((4-oxo-3,4-dihydrothieno[3,2-d]pyrimidin-2-yl)methyl)piperidin-4-yl)isoindolin-2-yl)piperidine-2,6-dione |
| I-214 | 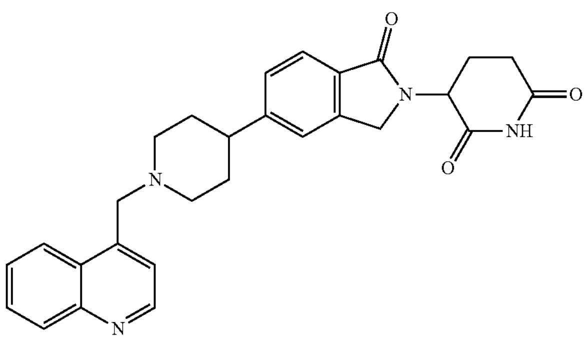 [SMILES: O=C1CCC(N2Cc3cc(C4CCN(Cc5ccnc6ccccc56)CC4)ccc3C2=O)C(=O)N1] | 3-(1-oxo-5-(1-(quinolin-4-ylmethyl)piperidin-4-yl)isoindolin-2-yl)piperidine-2,6-dione |
| I-215 | 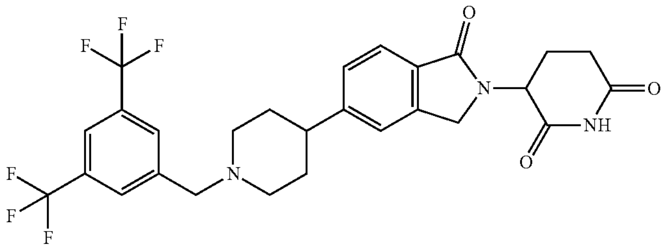 [SMILES: O=C1CCC(N2Cc3cc(C4CCN(Cc5cc(C(F)(F)F)cc(C(F)(F)F)c5)CC4)ccc3C2=O)C(=O)N1] | 3-(5-(1-(3,5-bis(trifluoromethyl)benzyl)piperidin-4-yl)-1-oxoisoindolin-2-yl)piperidine-2,6-dione |
| I-216 | 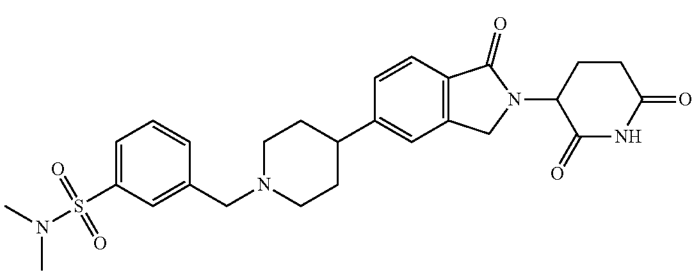 [SMILES: CN(C)S(=O)(=O)c1cccc(CN2CCC(c3ccc4c(c3)CN(C3CCC(=O)NC3=O)C4=O)CC2)c1] | 3-((4-(2-(2,6-dioxopiperidin-3-yl)-1-oxoisoindolin-5-yl)piperidin-1-yl)methyl)-N,N-dimethylbenzenesulfonamide |
| I-217 | 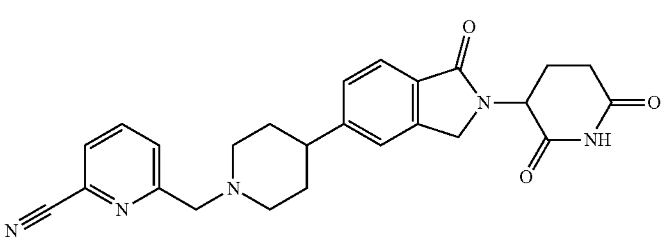 [SMILES: N#Cc1cccc(CN2CCC(c3ccc4c(c3)CN(C3CCC(=O)NC3=O)C4=O)CC2)n1] | 6-((4-(2-(2,6-dioxopiperidin-3-yl)-1-oxoisoindolin-5-yl)piperidin-1-yl)methyl)picolinonitrile |

TABLE 29-continued

Exemplary degradation compounds

| Cmpd No. | Structure | Compound Name |
|---|---|---|
| I-218 | 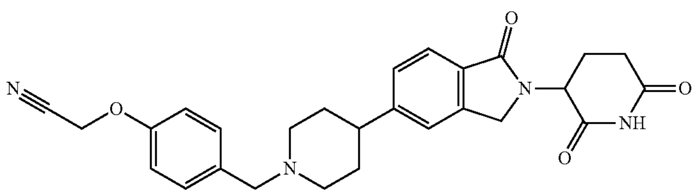 [SMILES: N#CCOc1ccc(CN2CCC(c3ccc4c(c3)CN(C3CCC(=O)NC3=O)C4=O)CC2)cc1] | 2-(4-((4-(2-(2,6-dioxo-piperidin-3-yl)-1-oxoisoindolin-5-yl)piperidin-1-yl)methyl)phenoxy)acetonitrile |
| I-219 | 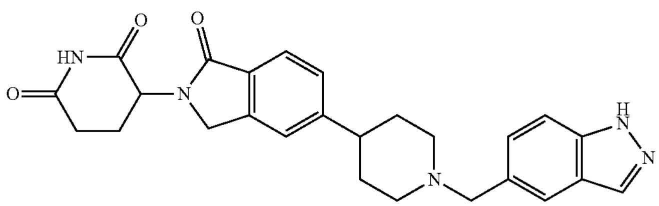 [SMILES: O=C1CCC(N2Cc3cc(C4CCN(Cc5ccc6[nH]ncc6c5)CC4)ccc3C2=O)C(=O)N1] | 3-(5-(1-((1H-indazol-5-yl)methyl)piperidin-4-yl)-1-oxoisoindolin-2-yl)piperidine-2,6-dione |
| I-220 | 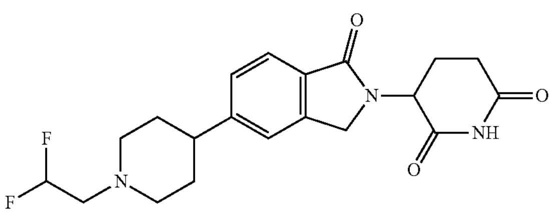 [SMILES: O=C1CCC(N2Cc3cc(C4CCN(CC(F)F)CC4)ccc3C2=O)C(=O)N1] | 3-(5-(1-(2,2-difluoroethyl)piperidin-4-yl)-1-oxoisoindolin-2-yl)piperidine-2,6-dione |
| I-221 | 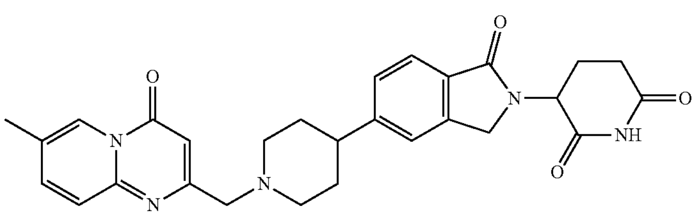 [SMILES: Cc1ccc2nc(CN3CCC(c4ccc5c(c4)CN(C4CCC(=O)NC4=O)C5=O)CC3)cc(=O)n2c1] | 3-(5-(1-((7-methyl-4-oxo-4H-pyrido[1,2-a]pyrimidin-2-yl)methyl)piperidin-4-yl)-1-oxoisoindolin-2-yl)piperidine-2,6-dione |
| I-222 | 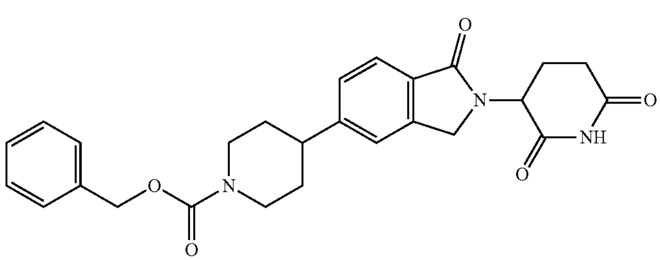 [SMILES: O=C1CCC(N2Cc3cc(C4CCN(C(=O)OCc5ccccc5)CC4)ccc3C2=O)C(=O)N1] | benzyl 4-(2-(2,6-dioxopiperidin-3-yl)-1-oxoisoindolin-5-yl)piperidine-1-carboxylate |
| I-223 | 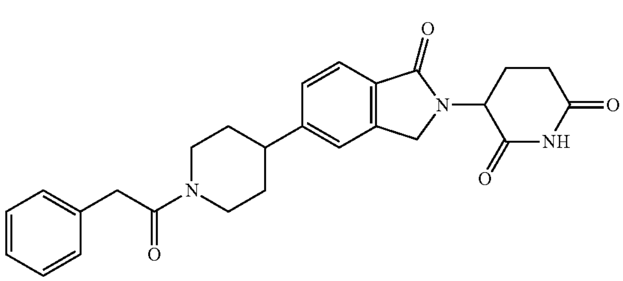 [SMILES: O=C1CCC(N2Cc3cc(C4CCN(C(=O)Cc5ccccc5)CC4)ccc3C2=O)C(=O)N1] | 3-(1-oxo-5-(1-(2-phenylacetyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-224 | 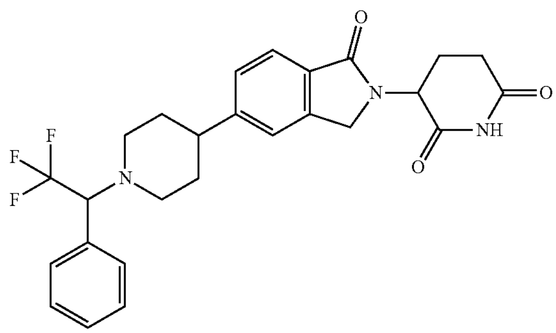 [SMILES: O=C1CCC(N2Cc3cc(C4CCN(C(c5ccccc5)C(F)(F)F)CC4)ccc3C2=O)C(=O)N1] | 3-(1-oxo-5-(1-(2,2,2-trifluoro-1-phenylethyl)piperidin-4-yl)isoindolin-2-yl)piperidine-2,6-dione |
| I-225 | 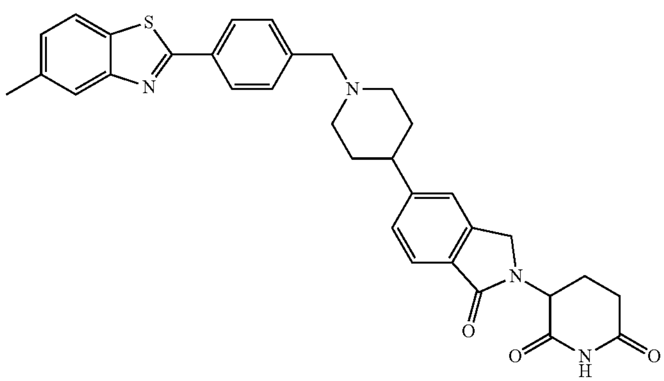 [SMILES: Cc1ccc2sc(-c3ccc(CN4CCC(c5ccc6c(c5)CN(C5CCC(=O)NC5=O)C6=O)CC4)cc3)nc2c1] | 3-(5-(1-(4-(5-methylbenzo[d]thiazol-2-yl)benzyl)piperidin-4-yl)-1-oxoisoindolin-2-yl)piperidine-2,6-dione |
| I-226 | 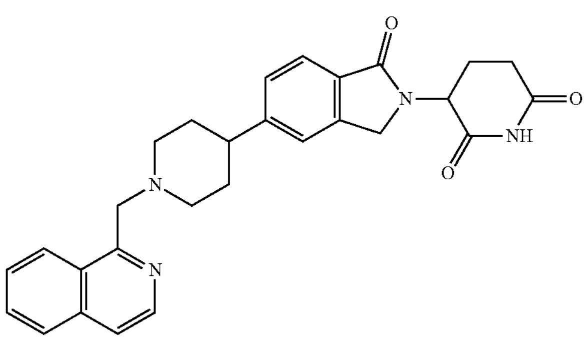 [SMILES: O=C1CCC(N2Cc3cc(C4CCN(Cc5nccc6ccccc56)CC4)ccc3C2=O)C(=O)N1] | 3-(5-(1-(iso-quinolin-1-ylmethyl)piperidin-4-yl)-1-oxoisoindolin-2-yl)piperidine-2,6-dione |
| I-227 | 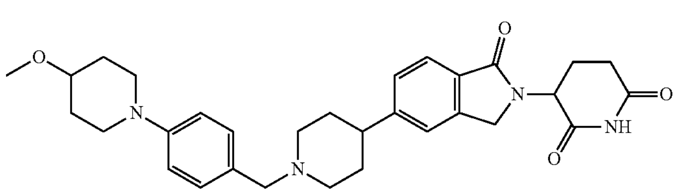 [SMILES: COC1CCN(c2ccc(CN3CCC(c4ccc5c(c4)CN(C4CCC(=O)NC4=O)C5=O)CC3)cc2)CC1] | 3-(5-(1-(4-(4-methoxypiperidin-1-yl)benzyl)piperidin-4-yl)-1-oxoisoindolin-2-yl)piperidine-2,6-dione |
| I-228 | 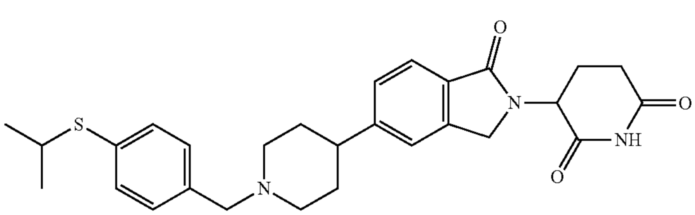 [SMILES: CC(C)Sc1ccc(CN2CCC(c3ccc4c(c3)CN(C3CCC(=O)NC3=O)C4=O)CC2)cc1] | 3-(5-(1-(4-(isopropylthio)benzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-229 | 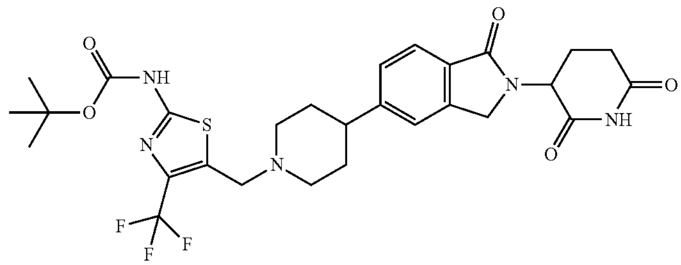 [SMILES: CC(C)(C)OC(=O)Nc1nc(C(F)(F)F)c(CN2CCC(c3ccc4c(c3)CN(C3CCC(=O)NC3=O)C4=O)CC2)s1] | tert-butyl (5-((4-(2-(2,6-dioxo-piperidin-3-yl)-1-oxoisoindolin-5-yl)piperidin-1-yl)methyl)-4-(trifluoromethyl)thiazol-2-yl)carbamate |
| I-230 | 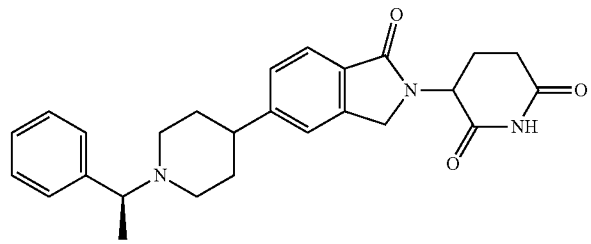 [SMILES: C[C@@H](c1ccccc1)N1CCC(c2ccc3c(c2)CN(C2CCC(=O)NC2=O)C3=O)CC1] | 3-(1-oxo-5-(1-((S)-1-phenylethyl)piperidin-4-yl)isoindolin-2-yl)piperidine-2,6-dione |
| I-231 | 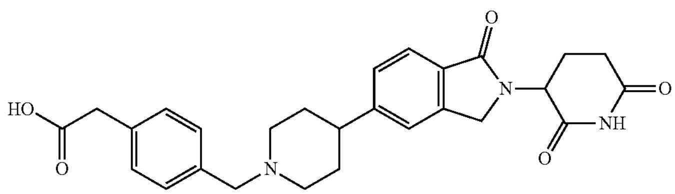 [SMILES: O=C(O)Cc1ccc(CN2CCC(c3ccc4c(c3)CN(C3CCC(=O)NC3=O)C4=O)CC2)cc1] | 2-(4-((4-(2-(2,6-dioxopiperidin-3-yl)-1-oxoisoindolin-5-yl)piperidin-1-yl)methyl)phenyl)acetic acid |
| I-232 | 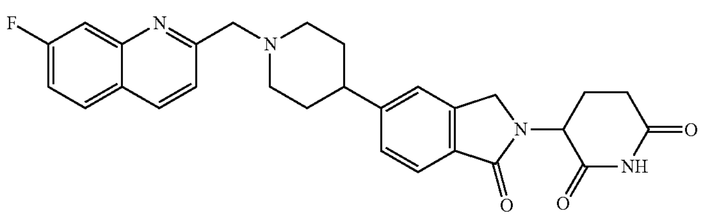 [SMILES: O=C1CCC(N2Cc3cc(C4CCN(Cc5ccc6ccc(F)cc6n5)CC4)ccc3C2=O)C(=O)N1] | 3-(5-(1-((7-fluoro-quinolin-2-yl)methyl)piperidin-4-yl)-1-oxoisoindolin-2-yl)piperidine-2,6-dione |
| I-233 | 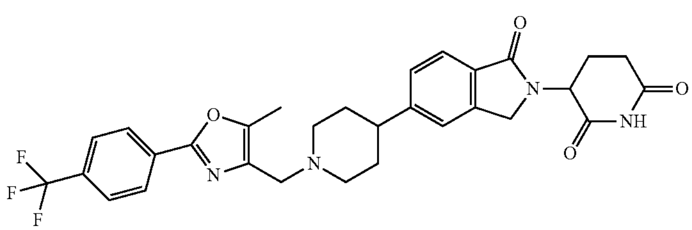 [SMILES: Cc1oc(-c2ccc(C(F)(F)F)cc2)nc1CN1CCC(c2ccc3c(c2)CN(C2CCC(=O)NC2=O)C3=O)CC1] | 3-(5-(1-((5-methyl-2-(4-(trifluoro-methyl)phenyl)oxazol-4-yl)methyl)piperidin-4-yl)-1-oxoisoindolin-2-yl)piperidine-2,6-dione |
| I-234 | 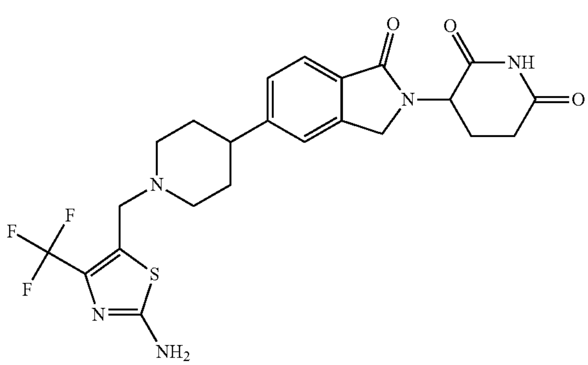 [SMILES: Nc1nc(C(F)(F)F)c(CN2CCC(c3ccc4c(c3)CN(C3CCC(=O)NC3=O)C4=O)CC2)s1] | 3-(5-(1-((2-amino-4-(trifluoromethyl)thiazol-5-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-235 | 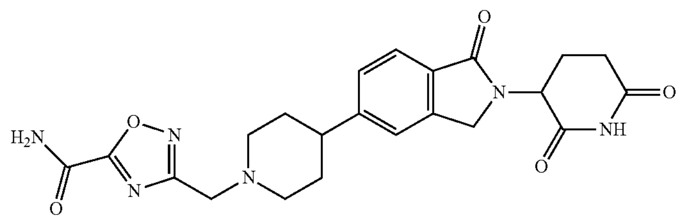 [SMILES: NC(=O)c1nc(CN2CCC(c3ccc4c(c3)CN(C3CCC(=O)NC3=O)C4=O)CC2)no1] | 3-((4-(2-(2,6-dioxopiperidin-3-yl)-1-oxoisoindolin-5-yl)piperidin-1-yl)methyl)-1,2,4-oxadiazole-5-carboxamide |
| I-236 | 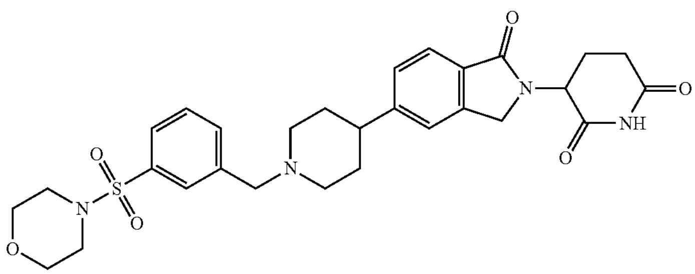 [SMILES: O=C1CCC(N2Cc3cc(C4CCN(Cc5cccc(S(=O)(=O)N6CCOCC6)c5)CC4)ccc3C2=O)C(=O)N1] | 3-(5-(1-(3-(morpholinosulfonyl)benzyl)piperidin-4-yl)-1-oxoisoindolin-2-yl)piperidine-2,6-dione |
| I-237 | 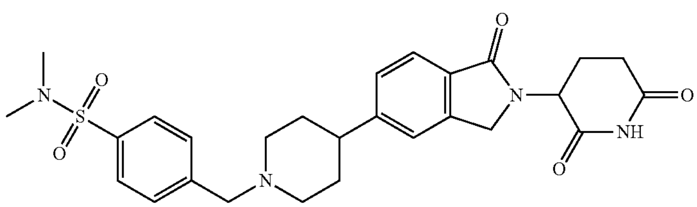 [SMILES: CN(C)S(=O)(=O)c1ccc(CN2CCC(c3ccc4c(c3)CN(C3CCC(=O)NC3=O)C4=O)CC2)cc1] | 4-((4-(2-(2,6-dioxopiperidin-3-yl)-1-oxoisoindolin-5-yl)piperidin-1-yl)methyl)-N,N-dimethylbenzenesulfonamide |
| I-238 | 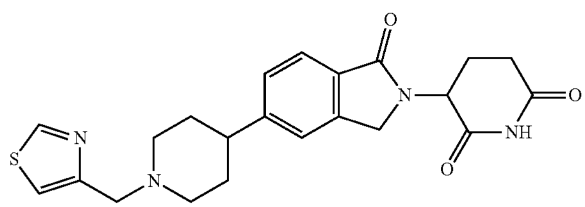 [SMILES: O=C1CCC(N2Cc3cc(C4CCN(Cc5cscn5)CC4)ccc3C2=O)C(=O)N1] | 3-(1-oxo-5-(1-(thiazol-4-ylmethyl)piperidin-4-yl)isoindolin-2-yl)piperidine-2,6-dione |
| I-239 | 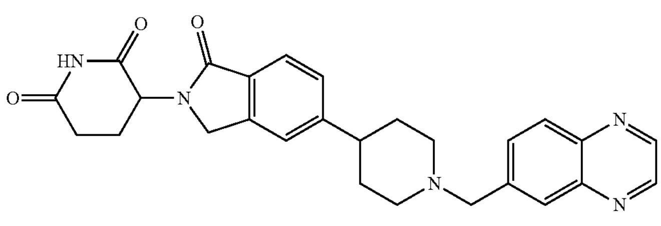 [SMILES: O=C1CCC(N2Cc3cc(C4CCN(Cc5ccc6nccnc6c5)CC4)ccc3C2=O)C(=O)N1] | 3-(1-oxo-5-(1-(quinoxalin-6-ylmethyl)piperidin-4-yl)isoindolin-2-yl)piperidine-2,6-dione |
| I-240 | 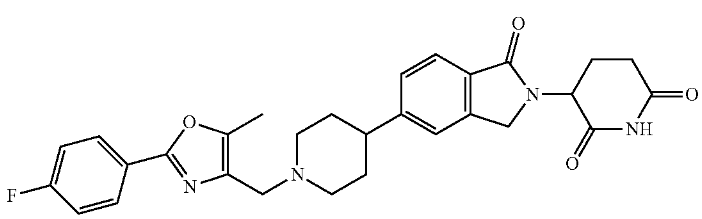 [SMILES: Cc1oc(-c2ccc(F)cc2)nc1CN1CCC(c2ccc3c(c2)CN(C2CCC(=O)NC2=O)C3=O)CC1] | 3-(5-(1-((2-(4-fluorophenyl)-5-methyloxazol-4-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-241 | 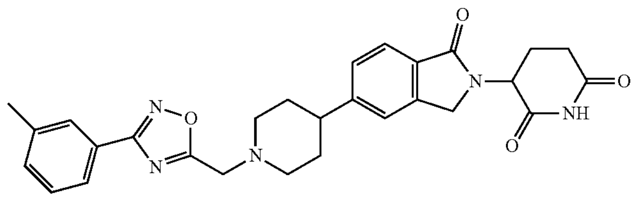 [SMILES: Cc1cccc(-c2noc(CN3CCC(c4ccc5c(c4)CN(C4CCC(=O)NC4=O)C5=O)CC3)n2)c1] | 3-(1-oxo-5-(1-((3-(m-tolyl)-1,2,4-oxadiazol-5-yl)methyl)piperidin-4-yl)isoindolin-2-yl)piperidine-2,6-dione |
| I-242 | 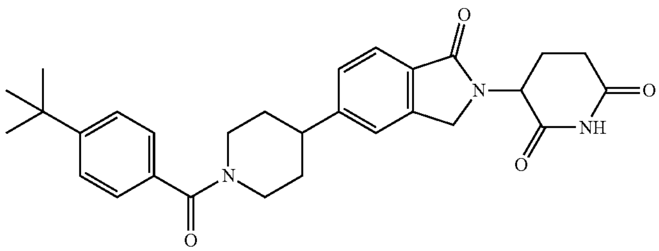 [SMILES: CC(C)(C)c1ccc(C(=O)N2CCC(c3ccc4c(c3)CN(C3CCC(=O)NC3=O)C4=O)CC2)cc1] | 3-(5-(1-(4-(tert-butyl)benzoyl)piperidin-4-yl)-1-oxoisoindolin-2-yl)piperidine-2,6-dione |
| I-243 | 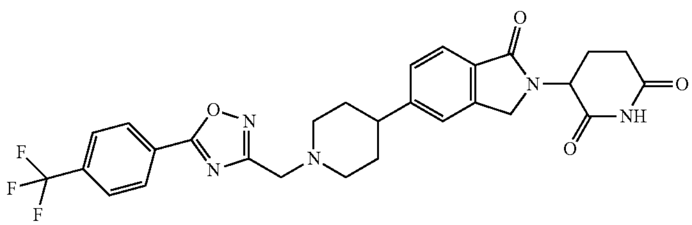 [SMILES: O=C1CCC(N2Cc3cc(C4CCN(Cc5noc(-c6ccc(C(F)(F)F)cc6)n5)CC4)ccc3C2=O)C(=O)N1] | 3-(1-oxo-5-(1-((5-(4-(trifluoromethyl)phenyl)-1,2,4-oxadiazol-3-yl)methyl)piperidin-4-yl)isoindolin-2-yl)piperidine-2,6-dione |
| I-244 | 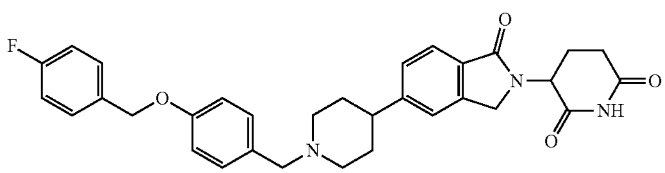 [SMILES: O=C1CCC(N2Cc3cc(C4CCN(Cc5ccc(OCc6ccc(F)cc6)cc5)CC4)ccc3C2=O)C(=O)N1] | 3-(5-(1-(4-((4-fluorobenzyl)oxy)benzyl)piperidin-4-yl)-1-oxoisoindolin-2-yl)piperidine-2,6-dione |
| I-245 | 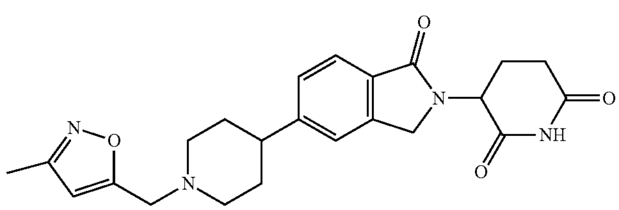 [SMILES: Cc1cc(CN2CCC(c3ccc4c(c3)CN(C3CCC(=O)NC3=O)C4=O)CC2)on1] | 3-(5-(1-((3-methylisoxazol-5-yl)methyl)piperidin-4-yl)-1-oxoisoindolin-2-yl)piperidine-2,6-dione |
| I-246 | 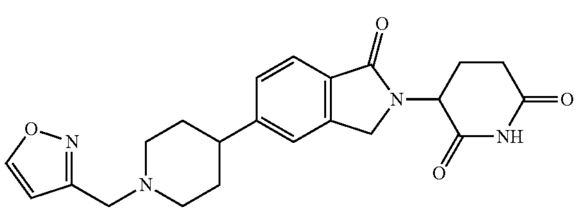 [SMILES: O=C1CCC(N2Cc3cc(C4CCN(Cc5ccon5)CC4)ccc3C2=O)C(=O)N1] | 3-(5-(1-(isoxazol-3-ylmethyl)piperidin-4-yl)-1-oxoisoindolin-2-yl)piperidine-2,6-dione |
| I-247 | 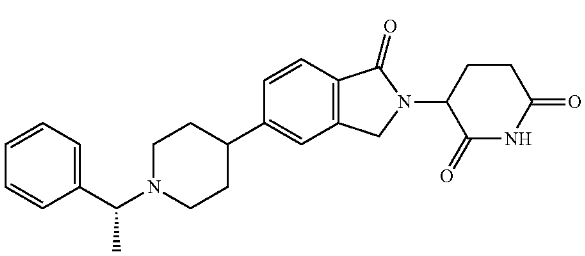 [SMILES: C[C@H](c1ccccc1)N1CCC(c2ccc3c(c2)CN(C2CCC(=O)NC2=O)C3=O)CC1] | 3-(1-oxo-5-(1-((R)-1-phenylethyl)piperidin-4-yl)isoindolin-2-yl)piperidine-2,6-dione |

TABLE 29-continued

Exemplary degradation compounds

| Cmpd No. | Structure | Compound Name |
|---|---|---|
| I-248 | 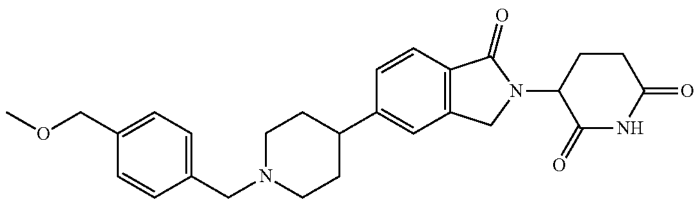 [SMILES: COCc1ccc(CN2CCC(c3ccc4c(c3)CN(C3CCC(=O)NC3=O)C4=O)CC2)cc1] | 3-(5-(1-(4-(methoxymethyl)benzyl)piperidin-4-yl)-1-oxoisoindolin-2-yl)piperidine-2,6-dione |
| I-249 | 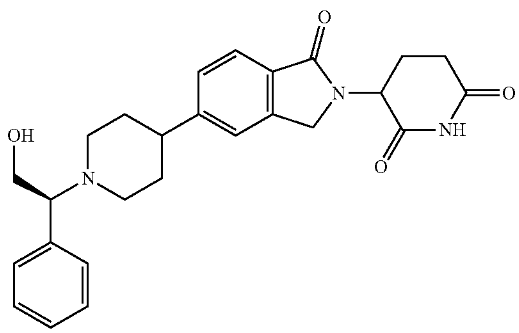 [SMILES: O=C1CCC(N2Cc3cc(C4CCN([C@H](CO)c5ccccc5)CC4)ccc3C2=O)C(=O)N1] | 3-(5-(1-((S)-2-hydroxy-1-phenylethyl)piperidin-4-yl)-1-oxoisoindolin-2-yl)piperidine-2,6-dione |
| I-250 | 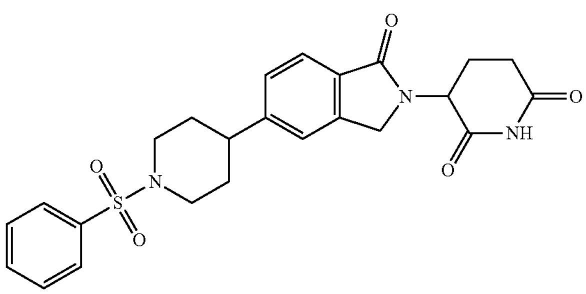 [SMILES: O=C1CCC(N2Cc3cc(C4CCN(S(=O)(=O)c5ccccc5)CC4)ccc3C2=O)C(=O)N1] | 3-(1-oxo-5-(1-(phenylsulfonyl)piperidin-4-yl)isoindolin-2-yl)piperidine-2,6-dione |
| I-251 | 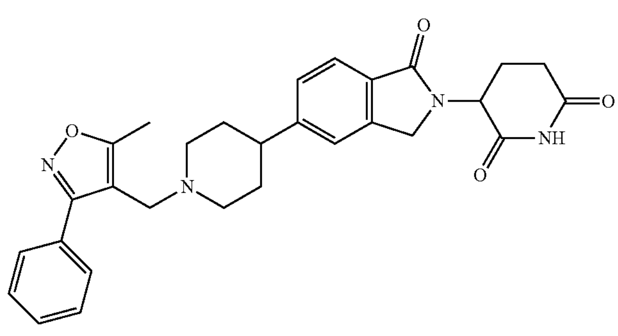 [SMILES: Cc1onc(-c2ccccc2)c1CN1CCC(c2ccc3c(c2)CN(C2CCC(=O)NC2=O)C3=O)CC1] | 3-(5-(1-((5-methyl-3-phenylisoxazol-4-yl)methyl)piperidin-4-yl)-1-oxoisoindolin-2-yl)piperidine-2,6-dione |
| I-252 | 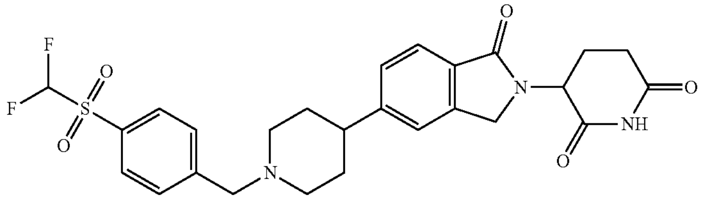 [SMILES: O=C1CCC(N2Cc3cc(C4CCN(Cc5ccc(S(=O)(=O)C(F)F)cc5)CC4)ccc3C2=O)C(=O)N1] | 3-(5-(1-(4-((difluoromethyl)sulfonyl)benzyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-253 | 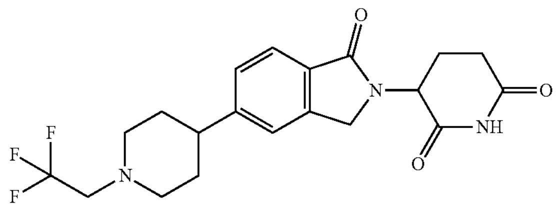 [SMILES: O=C1CCC(N2Cc3cc(C4CCN(CC(F)(F)F)CC4)ccc3C2=O)C(=O)N1] | 3-(1-oxo-5-(1-(2,2,2-trifluoro-ethyl)piperidin-4-yl)isoindolin-2-yl)piperidine-2,6-dione |
| I-254 | 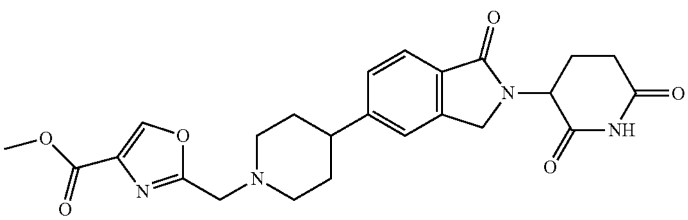 [SMILES: COC(=O)c1coc(CN2CCC(c3ccc4c(c3)CN(C3CCC(=O)NC3=O)C4=O)CC2)n1] | methyl 2-((4-(2-(2,6-dioxopiperidin-3-yl)-1-oxoisoindolin-5-yl)piperidin-1-yl)methyl)oxazole-4-carboxylate |
| I-255 | 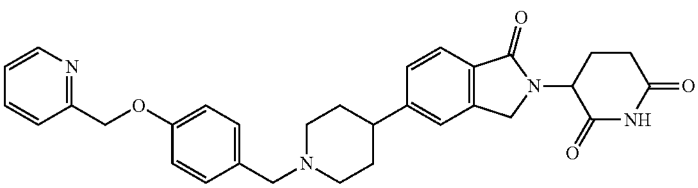 [SMILES: O=C1CCC(N2Cc3cc(C4CCN(Cc5ccc(OCc6ccccn6)cc5)CC4)ccc3C2=O)C(=O)N1] | 3-(1-oxo-5-(1-(4-(pyridin-2-ylmethoxy)benzyl)piperidin-4-yl)isoindolin-2-yl)piperidine-2,6-dione |
| I-256 | 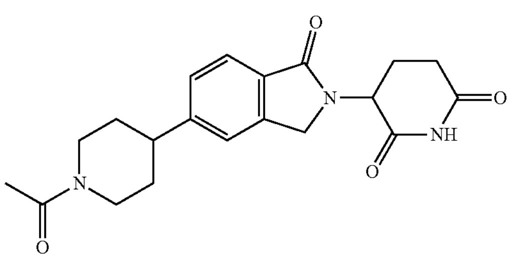 [SMILES: CC(=O)N1CCC(c2ccc3c(c2)CN(C2CCC(=O)NC2=O)C3=O)CC1] | 3-(5-(1-acetyl-piperidin-4-yl)-1-oxoisoindolin-2-yl)piperidine-2,6-dione |
| I-257 | 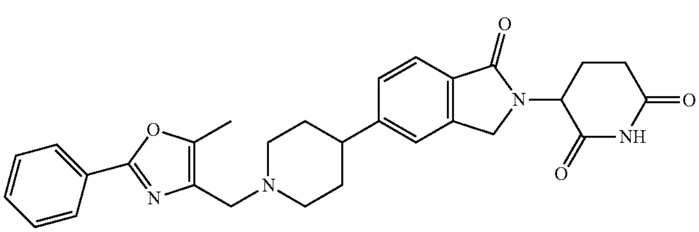 [SMILES: Cc1oc(-c2ccccc2)nc1CN1CCC(c2ccc3c(c2)CN(C2CCC(=O)NC2=O)C3=O)CC1] | 3-(5-(1-((5-methyl-2-phenyloxazol-4-yl)methyl)piperidin-4-yl)-1-oxoisoindolin-2-yl)piperidine-2,6-dione |
| I-258 | 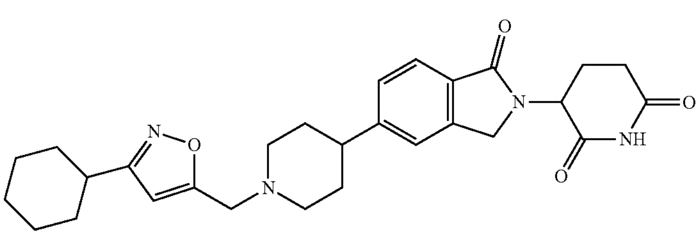 [SMILES: O=C1CCC(N2Cc3cc(C4CCN(Cc5cc(C6CCCCC6)no5)CC4)ccc3C2=O)C(=O)N1] | 3-(5-(1-((3-cyclohexyl-isoxazol-5-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-259 | 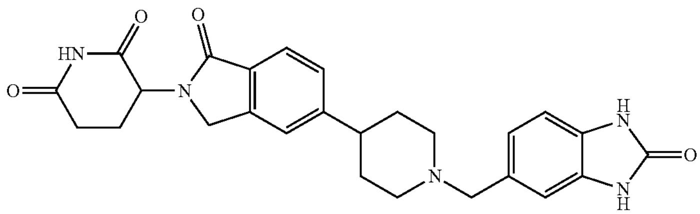 [SMILES: O=C1CCC(N2Cc3cc(C4CCN(Cc5ccc6[nH]c(=O)[nH]c6c5)CC4)ccc3C2=O)C(=O)N1] | 3-(1-oxo-5-(1-((2-oxo-2,3-dihydro-1H-benzo[d]imidazol-5-yl)methyl)piperidin-4-yl)isoindolin-2-yl)piperidine-2,6-dione |
| I-260 | 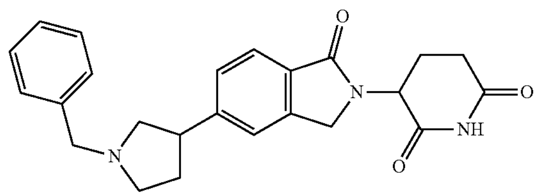 [SMILES: O=C1CCC(N2Cc3cc(C4CCN(Cc5ccccc5)C4)ccc3C2=O)C(=O)N1] | 3-(5-(1-benzylpyrrolidin-3-yl)-1-oxoisoindolin-2-yl)piperidine-2,6-dione |
| I-261 | 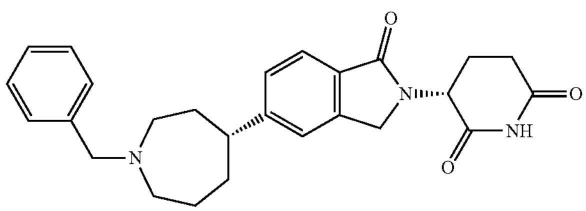 [SMILES: O=C1CC[C@@H](N2Cc3cc([C@@H]4CCCN(Cc5ccccc5)CC4)ccc3C2=O)C(=O)N1] | (R)-3-(5-((R)-1-benzylazepan-4-yl)-1-oxoisoindolin-2-yl)piperidine-2,6-dione |
| I-262 | 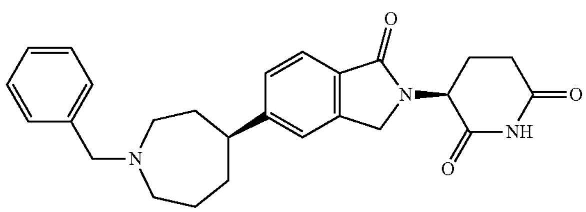 [SMILES: O=C1CC[C@H](N2Cc3cc([C@H]4CCCN(Cc5ccccc5)CC4)ccc3C2=O)C(=O)N1] | (S)-3-(5-((S)-1-benzylazepan-4-yl)-1-oxoisoindolin-2-yl)piperidine-2,6-dione |
| I-263 | 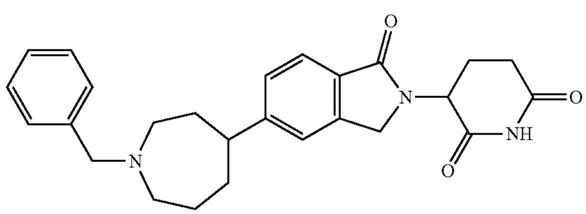 [SMILES: O=C1CCC(N2Cc3cc(C4CCCN(Cc5ccccc5)CC4)ccc3C2=O)C(=O)N1] | 3-(5-(1-benzylazepan-4-yl)-1-oxoisoindolin-2-yl)piperidine-2,6-dione |
| I-264 | 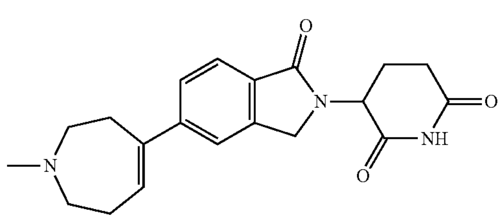 [SMILES: CN1CCC=C(c2ccc3c(c2)CN(C2CCC(=O)NC2=O)C3=O)CC1] | 3-(5-(1-methyl-2,3,6,7-tetrahydro-1H-azepin-4-yl)-1-oxoisoindolin-2-yl)piperidine-2,6-dione |
| I-265 | 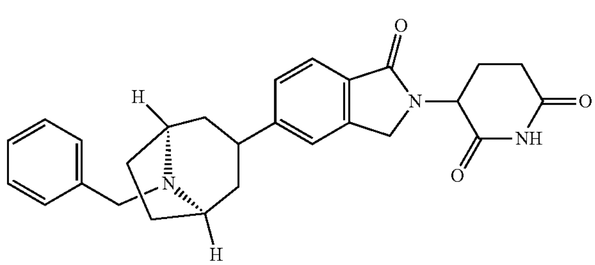 [SMILES: O=C1CCC(N2Cc3cc(C4C[C@H]5CC[C@@H](C4)N5Cc4ccccc4)ccc3C2=O)C(=O)N1] | 3-(5-(8-benzyl-8-azabicyclo[3.2.1]octan-3-yl)-1-oxoisoindolin-2-yl)piperidine-2,6-dione |

TABLE 29-continued

Exemplary degradation compounds

| Cmpd No. | Structure | Compound Name |
|---|---|---|
| I-266 | 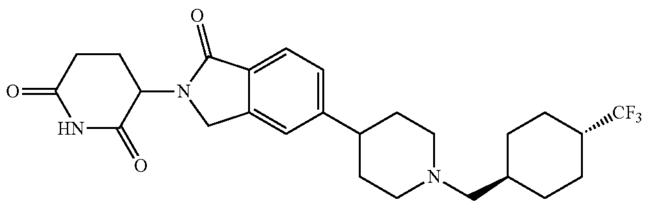 [SMILES: O=C1CCC(N2Cc3cc(C4CCN(C[C@H]5CC[C@H](C(F)(F)F)CC5)CC4)ccc3C2=O)C(=O)N1] | trans-3-(1-oxo-5-(1-((4-(trifluoro-methyl)cyclohexyl)methyl)piperidin-4-yl)isoindolin-2-yl)piperidine-2,6-dione |
| I-267 | 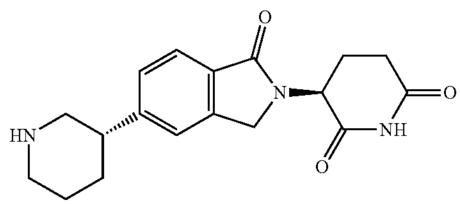 [SMILES: O=C1CC[C@H](N2Cc3cc([C@@H]4CCCNC4)ccc3C2=O)C(=O)N1] | (S)-3-(1-oxo-5-((S)-piperidin-3-yl)isoindolin-2-yl)piperidine-2,6-dione |
| I-268 | 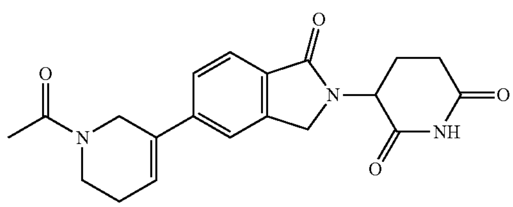 [SMILES: CC(=O)N1CCC=C(c2ccc3c(c2)CN(C2CCC(=O)NC2=O)C3=O)C1] | 3-(5-(1-acetyl-1,2,5,6-tetrahydro-pyridin-3-yl)-1-oxoisoindolin-2-yl)piperidine-2,6-dione |
| I-269 | 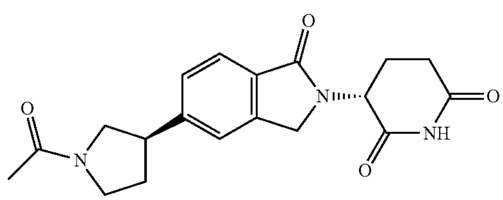 [SMILES: CC(=O)N1CC[C@H](c2ccc3c(c2)CN([C@@H]2CCC(=O)NC2=O)C3=O)C1] | (R)-3-(5-((R)-1-acetylpyrrolidin-3-yl)-1-oxoisoindolin-2-yl)piperidine-2,6-dione |
| I-270 | 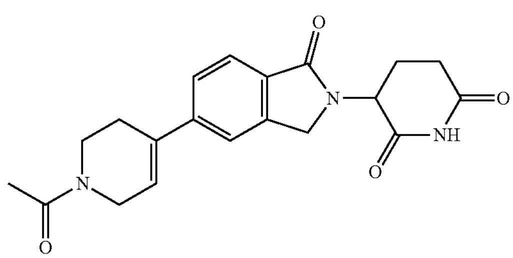 [SMILES: CC(=O)N1CC=C(c2ccc3c(c2)CN(C2CCC(=O)NC2=O)C3=O)CC1] | 3-(5-(1-acetyl-1,2,3,6-tetra-hydropyridin-4-yl)-1-oxoiso-indolin-2-yl)piperidine-2,6-dione |
| I-271 | 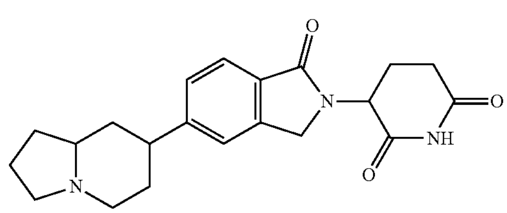 [SMILES: O=C1CCC(N2Cc3cc(C4CCN5CCCC5C4)ccc3C2=O)C(=O)N1] | 3-(5-(octahydro-indolizin-7-yl)-1-oxoisoindolin-2-yl)piperidine-2,6-dione |
| I-272 | 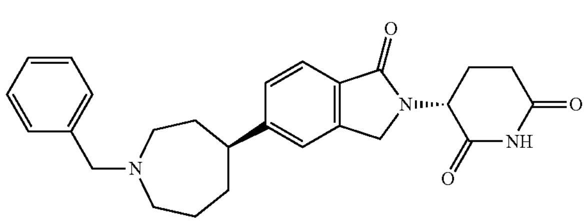 [SMILES: O=C1CC[C@@H](N2Cc3cc([C@H]4CCCN(Cc5ccccc5)CC4)ccc3C2=O)C(=O)N1] | (R)-3-(5-((S)-1-benzylazepan-4-yl)-1-oxoiso-indolin-2-yl)piperidine-2,6-dione |

TABLE 29-continued

Exemplary degradation compounds

| Cmpd No. | Structure | Compound Name |
|---|---|---|
| I-273 | 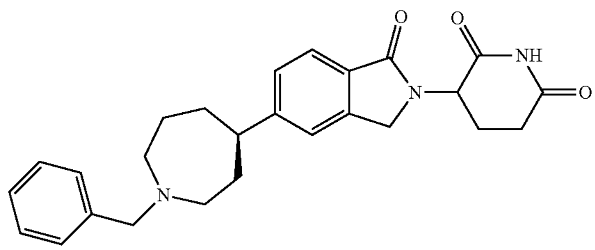 [SMILES: O=C1CCC(N2Cc3cc([C@@H]4CCCN(Cc5ccccc5)CC4)ccc3C2=O)C(=O)N1] | 3-(5-((R)-1-benzylazepan-4-yl)-1-oxoisoindolin-2-yl)piperidine-2,6-dione |
| I-274 | 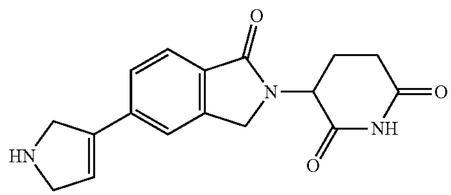 [SMILES: O=C1CCC(N2Cc3cc(C4=CCNC4)ccc3C2=O)C(=O)N1] | 3-(5-(2,5-dihydro-1H-pyrrol-3-yl)-1-oxoisoindolin-2-yl)piperidine-2,6-dione |
| I-275 | 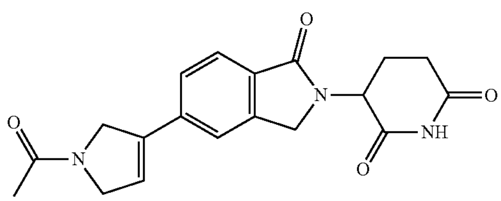 [SMILES: CC(=O)N1CC=C(c2ccc3c(c2)CN(C2CCC(=O)NC2=O)C3=O)C1] | 3-(5-(1-acetyl-2,5-dihydro-1H-pyrrol-3-yl)-1-oxoisoindolin-2-yl)piperidine-2,6-dione |
| I-276 | 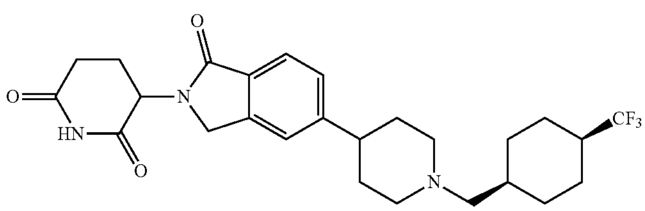 [SMILES: O=C1CCC(N2Cc3cc(C4CCN(C[C@H]5CC[C@@H](C(F)(F)F)CC5)CC4)ccc3C2=O)C(=O)N1] | cis-3-(1-oxo-5-(1-((4-(trifluoromethyl)cyclohexyl)methyl)piperidin-4-yl)isoindolin-2-yl)piperidine-2,6-dione |
| I-277 | 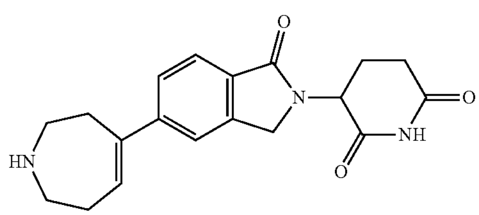 [SMILES: O=C1CCC(N2Cc3cc(C4=CCCNCC4)ccc3C2=O)C(=O)N1] | 3-(1-oxo-5-(2,3,6,7-tetrahydro-1H-azepin-4-yl)isoindolin-2-yl)piperidine-2,6-dione |
| I-278 | 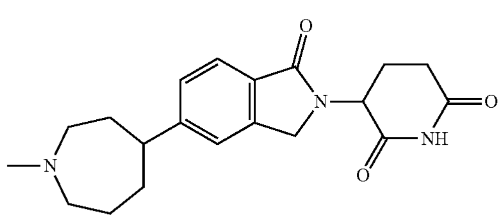 [SMILES: CN1CCCC(c2ccc3c(c2)CN(C2CCC(=O)NC2=O)C3=O)CC1] | 3-(5-(1-methylazepan-4-yl)-1-oxoisoindolin-2-yl)piperidine-2,6-dione |
| I-279 | 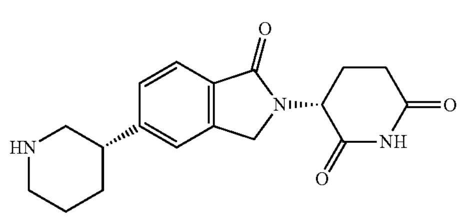 [SMILES: O=C1CC[C@@H](N2Cc3cc([C@@H]4CCCNC4)ccc3C2=O)C(=O)N1] | (R)-3-(1-oxo-5-((S)-piperidin-3-yl)isoindolin-2-yl)piperidine-2,6-dione |

TABLE 29-continued

Exemplary degradation compounds

| Cmpd No. | Structure | Compound Name |
|---|---|---|
| I-280 | 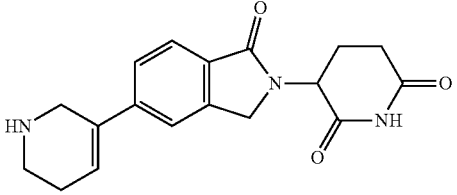 | 3-(1-oxo-5-(1,2,3,6-tetrahydropyridin-4-yl)isoindolin-2-yl)piperidine-2,6-dione |
| I-281 | 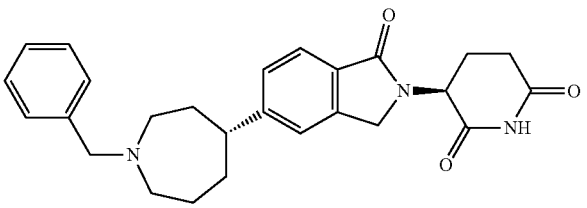 [SMILES: O=C1CC[C@H](N2Cc3cc([C@@H]4CCCN(Cc5ccccc5)CC4)ccc3C2=O)C(=O)N1] | (S)-3-(5-((R)-1-benzylazepan-4-yl)-1-oxoisoindolin-2-yl)piperidine-2,6-dione |
| I-282 | 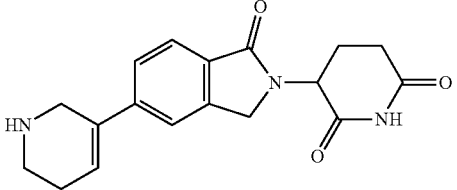 [SMILES: O=C1CCC(N2Cc3cc(C4=CCCNC4)ccc3C2=O)C(=O)N1] | 3-(1-oxo-5-(1,2,5,6-tetrahydropyridin-3-yl)isoindolin-2-yl)piperidine-2,6-dione |
| I-283 | 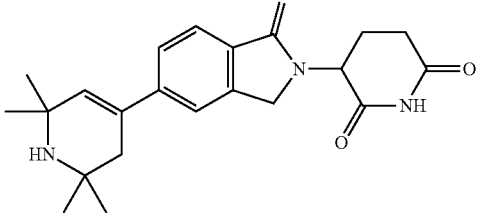 | 3-(1-oxo-5-(2,2,6,6-tetramethyl-1,2,3,6-tetrahydropyridin-4-yl)isoindolin-2-yl)piperidine-2,6-dione |
| I-284 | 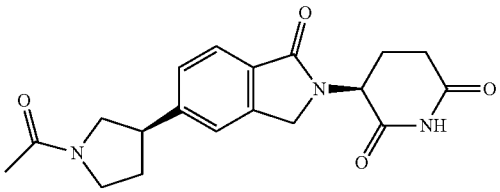 [SMILES: CC(=O)N1CC[C@H](c2ccc3c(c2)CN([C@H]2CCC(=O)NC2=O)C3=O)C1] | (S)-3-(5-((R)-1-acetylpyrrolidin-3-yl)-1-oxoisoindolin-2-yl)piperidine-2,6-dione |
| I-285 | 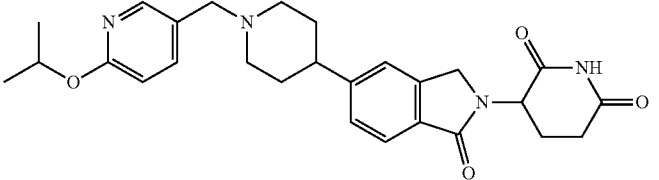 [SMILES: CC(C)Oc1ccc(CN2CCC(c3ccc4c(c3)CN(C3CCC(=O)NC3=O)C4=O)CC2)cn1] | 3-(5-(1-((6-isopropoxypyridin-3-yl)methyl)piperidin-4-yl)-1-oxoisoindolin-2-yl)piperidine-2,6-dione |

TABLE 29-continued

Exemplary degradation compounds

| Cmpd No. | Structure | Compound Name |
|---|---|---|
| I-286 | 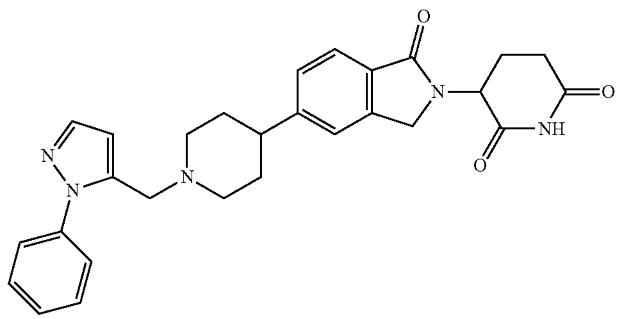 [SMILES: O=C1CCC(N2Cc3cc(C4CCN(Cc5ccnn5-c5ccccc5)CC4)ccc3C2=O)C(=O)N1] | 3-(1-oxo-5-(1-((1-phenyl-1H-pyrazol-5-yl)methyl)piperidin-4-yl)isoindolin-2-yl)piperidine-2,6-dione |
| I-287 | 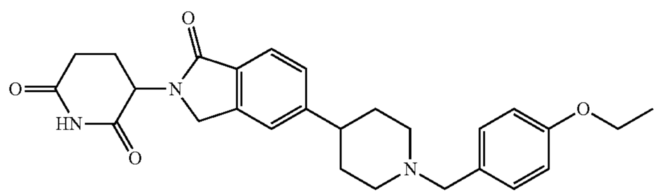 [SMILES: CCOc1ccc(CN2CCC(c3ccc4c(c3)CN(C3CCC(=O)NC3=O)C4=O)CC2)cc1] | 3-(5-(1-(4-ethoxybenzyl)piperidin-4-yl)-1-oxoisoindolin-2-yl)piperidine-2,6-dione |
| I-288 | 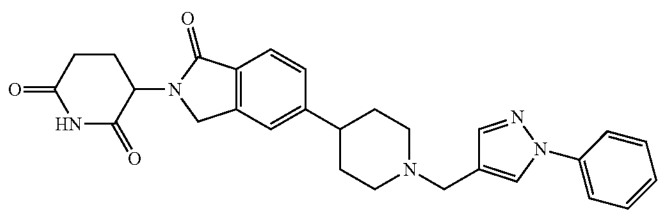 [SMILES: O=C1CCC(N2Cc3cc(C4CCN(Cc5cnn(-c6ccccc6)c5)CC4)ccc3C2=O)C(=O)N1] | 3-(1-oxo-5-(1-((1-phenyl-1H-pyrazol-4-yl)methyl)piperidin-4-yl)isoindolin-2-yl)piperidine-2,6-dione |
| I-289 | 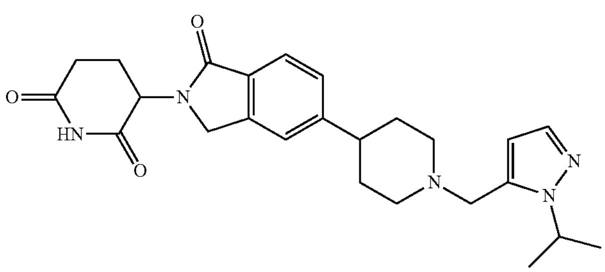 [SMILES: CC(C)n1nccc1CN1CCC(c2ccc3c(c2)CN(C2CCC(=O)NC2=O)C3=O)CC1] | 3-(5-(1-((1-isopropyl-1H-pyrazol-5-yl)methyl)piperidin-4-yl)-1-oxo-isoindolin-2-yl)piperidine-2,6-dione |
| I-290 | 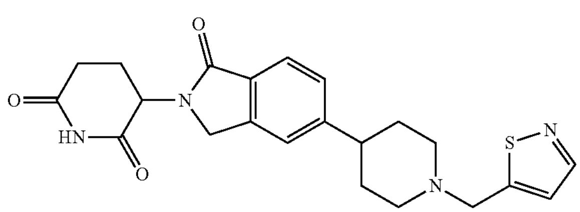 [SMILES: O=C1CCC(N2Cc3cc(C4CCN(Cc5ccns5)CC4)ccc3C2=O)C(=O)N1] | 3-(5-(1-(isothiazol-5-yl-methyl)piperidin-4-yl)-1-oxo-isoindolin-2-yl)piperidine-2,6-dione |
| I-291 | 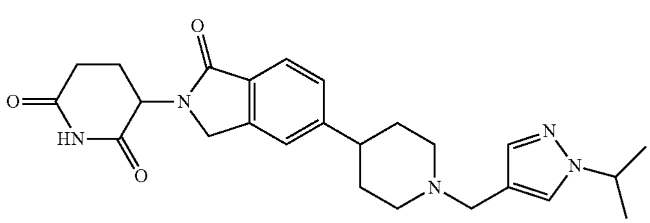 [SMILES: CC(C)n1cc(CN2CCC(c3ccc4c(c3)CN(C3CCC(=O)NC3=O)C4=O)CC2)cn1] | 3-(5-(1-((1-isopropyl-1H-pyrazol-4-yl)methyl)piperidin-4-yl)-1-oxo-isoindolin-2-yl)piperidine-2,6-dione |

TABLE 29-continued

Exemplary degradation compounds

| Cmpd No. | Structure | Compound Name |
|---|---|---|
| I-292 | 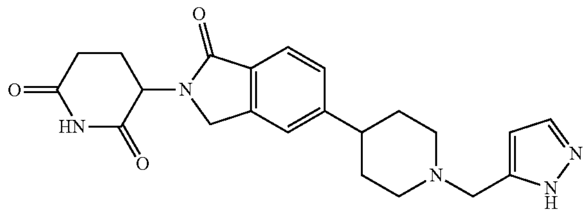 [SMILES: O=C1CCC(N2Cc3cc(C4CCN(Cc5ccn[nH]5)CC4)ccc3C2=O)C(=O)N1] | 3-(5-(1-((1H-pyrazol-5-yl)methyl)piperidin-4-yl)-1-oxo-isoindolin-2-yl)piperidine-2,6-dione |
| I-293 | 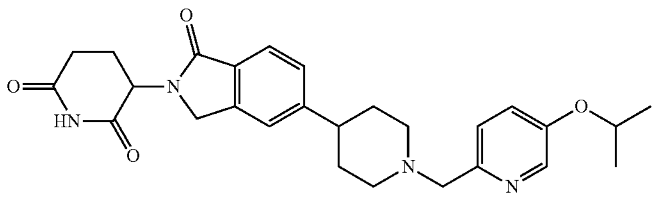 [SMILES: CC(C)Oc1ccc(CN2CCC(c3ccc4c(c3)CN(C3CCC(=O)NC3=O)C4=O)CC2)nc1] | 3-(5-(1-((5-iso-propoxypyridin-2-yl)methyl)piperidin-4-yl)-1-oxoisoindolin-2-yl)piperidine-2,6-dione |
| I-294 | 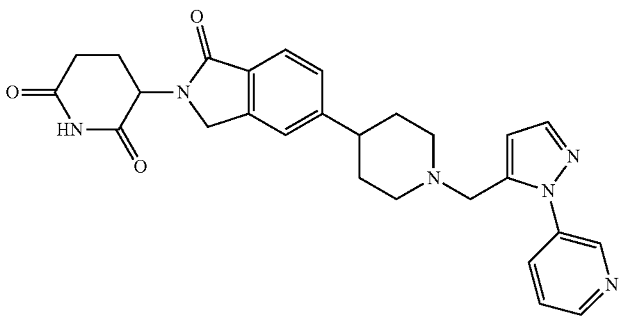 [SMILES: O=C1CCC(N2Cc3cc(C4CCN(Cc5ccnn5-c5cccnc5)CC4)ccc3C2=O)C(=O)N1] | 3-(1-oxo-5-(1-((1-(pyridin-3-yl)-1H-pyrazol-5-yl)methyl)piperidin-4-yl)isoindolin-2-yl)piperidine-2,6-dione |
| I-295 | 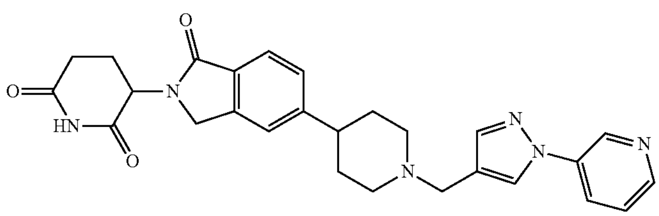 [SMILES: O=C1CCC(N2Cc3cc(C4CCN(Cc5cnn(-c6cccnc6)c5)CC4)ccc3C2=O)C(=O)N1] | 3-(1-oxo-5-(1-((1-(pyridin-3-yl)-1H-pyrazol-4-yl)methyl)piperidin-4-yl)isoindolin-2-yl)piperidine-2,6-dione |
| I-296 | 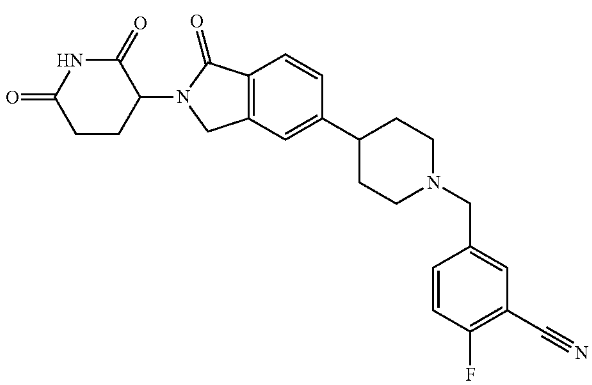 [SMILES: N#Cc1cc(CN2CCC(c3ccc4c(c3)CN(C3CCC(=O)NC3=O)C4=O)CC2)ccc1F] | 5-((4-(2-(2,6-dioxopiperidin-3-yl)-1-oxoiso-indolin-5-yl)piperidin-1-yl)methyl)-2-fluorobenzonitrile |
| I-297 | 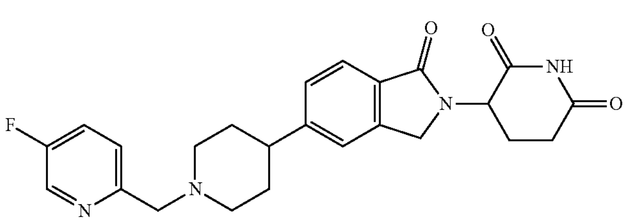 [SMILES: O=C1CCC(N2Cc3cc(C4CCN(Cc5ccc(F)cn5)CC4)ccc3C2=O)C(=O)N1] | 3-(5-(1-((5-fluoropyridin-2-yl)methyl)piperidin-4-yl)-1-oxoiso-indolin-2-yl)piperidine-2,6-dione |

TABLE 29-continued

Exemplary degradation compounds

| Cmpd No. | Structure | Compound Name |
|---|---|---|
| I-298 | 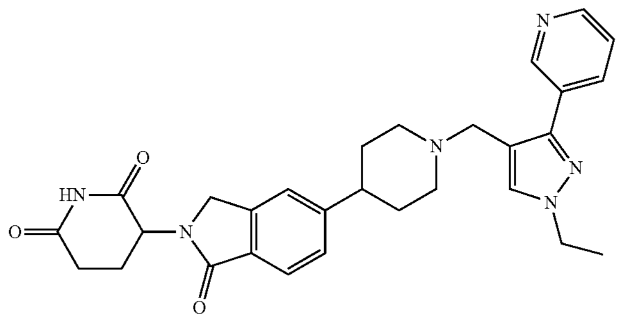 [SMILES: CCn1cc(CN2CCC(c3ccc4c(c3)CN(C3CCC(=O)NC3=O)C4=O)CC2)c(-c2cccnc2)n1] | 3-(5-(1-((1-ethyl-3-(pyridin-3-yl)-1H-pyrazol-4-yl)methyl)piperidin-4-yl)-1-oxoisoindolin-2-yl)piperidine-2,6-dione |
| I-299 | 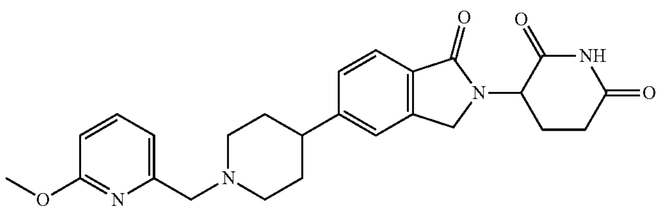 [SMILES: COc1cccc(CN2CCC(c3ccc4c(c3)CN(C3CCC(=O)NC3=O)C4=O)CC2)n1] | 3-(5-(1-((6-methoxypyridin-2-yl)methyl)piperidin-4-yl)-1-oxoisoindolin-2-yl)piperidine-2,6-dione |
| I-300 | 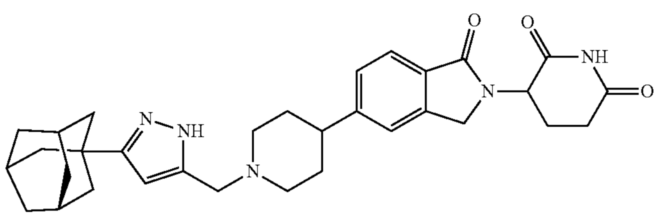 | 3-(5-(1-((3-((3S,5S)-adamantan-1-yl)-1H-pyrazol-5-yl)methyl)piperidin-4-yl)-1-oxoisoindolin-2-yl)piperidine-2,6-dione |
| I-301 | 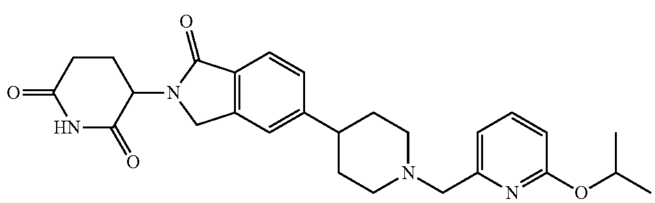 [SMILES: CC(C)Oc1cccc(CN2CCC(c3ccc4c(c3)CN(C3CCC(=O)NC3=O)C4=O)CC2)n1] | 3-(5-(1-((6-isopropoxypyridin-2-yl)methyl)piperidin-4-yl)-1-oxoisoindolin-2-yl)piperidine-2,6-dione |
| I-302 | 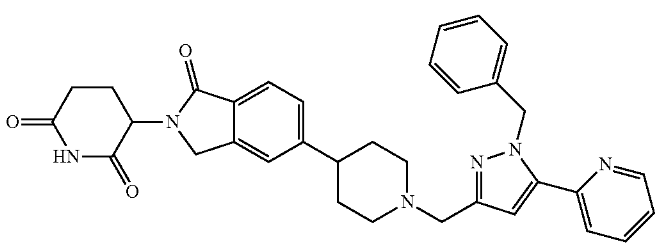 [SMILES: O=C1CCC(N2Cc3cc(C4CCN(Cc5cc(-c6ccccn6)n(Cc6ccccc6)n5)CC4)ccc3C2=O)C(=O)N1] | 3-(5-(1-((1-benzyl-5-(pyridin-2-yl)-1H-pyrazol-3-yl)methyl)piperidin-4-yl)-1-oxoisoindolin-2-yl)piperidine-2,6-dione |
| I-303 | 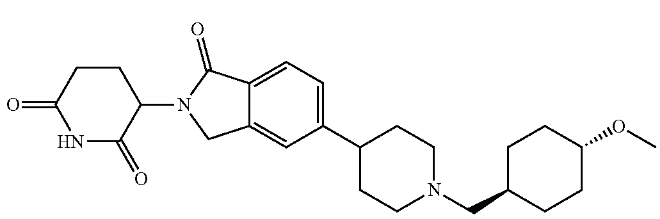 [SMILES: CO[C@H]1CC[C@H](CN2CCC(c3ccc4c(c3)CN(C3CCC(=O)NC3=O)C4=O)CC2)CC1] | trans-3-(5-(1-((4-methoxycyclohexyl)methyl)piperidin-4-yl)-1-oxoisoindolin-2-yl)piperidine-2,6-dione |

In another aspect, the degradation compound is a compound of Formula (II):

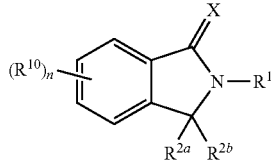

(II)

or a pharmaceutically acceptable salt, ester, hydrate, tautomer, or prodrug thereof, wherein:
X is O or S;
$R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by one or more $R^4$;
each of $R^{2a}$ and $R^{2b}$ is independently hydrogen or $C_1$-$C_6$ alkyl; or $R^{2a}$ and $R^{2b}$ together with the carbon atom to which they are attached to form carbonyl group or thiocarbonyl group;
each of $R^{10}$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)$_x$N($R^C$)($R^D$), or —N($R^C$)S(O)$_x R^E$, or L-Tag; wherein each alkyl, alkenyl, alkynyl, and heteroalkyl is independently and optionally substituted with one or more $R^{11}$;
each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, C(O)$R^A$, —C(O)O$R^B$, O$R^B$, —N($R^C$)($R^D$), —C(O)N($R^C$)($R^D$), —N($R^C$)C(O)$R^A$, S(O)$_x R^E$, —S(O)$_x$N($R^C$)($R^D$), —N($R^C$)S(O)$_x R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^7$;
each of $R^A$, $R^B$, $R^C$, $R^D$, and $R^E$ is independently hydrogen or $C_1$-$C_6$ alkyl;
each $R^{11}$ is independently $C_1$-$C_6$ alkyl, halo, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with one or more $R^8$;
each $R^7$ is independently halo, oxo, cyano, —O$R^B$, —N($R^C$)($R^D$), —C(O)N($R^C$)($R^D$), or —N($R^C$)C(O)$R^A$;
each $R^8$ is independently $C_1$-$C_6$ alkyl, halo, cyano, —O$R^B$, —N($R^C$)($R^D$), —C(O)N($R^C$)($R^D$), or —N($R^C$)C(O)$R^A$;
each L is independently $C_1$-$C_6$ alkyl, $C_2$-$C_6$ alkenyl, $C_2$-$C_6$ alkynyl, $C_1$-$C_6$ heteroalkyl, —C(O)$R^{A1}$, —C(O)O$R^{B1}$, —O$R^{B1}$, —N($R^{C1}$)($R^{D1}$), —C(O)N($R^{C1}$)($R^{D1}$), —N($R^{C1}$)C(O)$R^{A1}$, —S(O)$_x R^{E1}$, —S(O)$_x$N($R^{C1}$)($R^{D1}$), or —N($R^{C1}$)S(O)$_x R^{E1}$, wherein each alkyl, alkenyl, alkynyl, and heteroalkyl is independently and optionally substituted with one or more $R^{12}$;
each Tag is a targeting moiety capable of binding to a target protein;
each of $R^{A1}$, $R^{B1}$, $R^{C1}$, $R^{D1}$ and $R^{E1}$ is independently hydrogen, $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with one or more $R^{12}$;
each $R^{12}$ is independently $C_1$-$C_6$ alkyl, halo, cyano, carbocyclyl, or heterocyclyl;
n is 0, 1, 2, 3 or 4; and
x is 0, 1, or 2.

In some embodiments, X is O.

In some embodiments, $R^1$ is $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, each of which is independently and optionally substituted by 1-12 $R^4$ (e.g., 1 $R^4$, 2 $R^4$, 3 $R^4$, 4 $R^4$, 5 $R^4$, 6 $R^4$, 7 $R^4$, 8 $R^4$, 9 $R^4$, 10 $R^4$, 11 $R^4$, or 12 $R^4$). In some embodiments, $R^1$ is $C_1$-$C_6$ alkyl or heterocyclyl. In some embodiments, $R^1$ is $C_1$-$C_6$ alkyl (e.g., methyl or ethyl) substituted by $R^4$. In some embodiments, $R^1$ is $C_1$-$C_6$ alkyl (e.g., methyl or ethyl) substituted by 1-6 $R^4$. In some embodiments, $R^1$ is heterocyclyl. In some embodiments, $R^1$ is a 6-membered heterocyclyl or a 5-membered heterocyclyl. In some embodiments, $R^1$ is a 6-membered heterocyclyl or a 5-membered heterocyclyl optionally substituted with 1-6 $R^4$ (e.g., 1 $R^4$, 2 $R^4$, 3 $R^4$, 4 $R^4$, 5 $R^4$, or 6 $R^4$). In some embodiments, $R^1$ is a nitrogen-containing heterocyclyl. In some embodiments, $R^1$ is piperidinyl (e.g., piperidine-2,6-dionyl).

In some embodiments, each of $R^{2a}$ and $R^{2b}$ is independently hydrogen. In some embodiments, $R^{2a}$ and $R^{2b}$ together with the carbon to which they are attached form a carbonyl group.

In some embodiments, each $R^{10}$ is independently $C_1$-$C_6$ alkyl, $C_2$-$C_6$ alkenyl, $C_2$-$C_6$ alkynyl, $C_1$-$C_6$ heteroalkyl, halo, cyano, —C(O)$R^A$, —C(O)O$R^B$, —O$R^B$, —N($R^C$)($R^D$), —C(O)N($R^C$)($R^D$), —N($R^C$)C(O)$R^A$, —S(O)$_x R^E$, —S(O)$_x$N($R^C$)($R^D$), or —N($R^C$)S(O)$_x R^E$, or L-Tag; wherein each alkyl, alkenyl, alkynyl, and heteroalkyl is independently and optionally substituted with 1-12 $R^{11}$ (e.g., 1 $R^{11}$, 2 $R^{11}$, 3 $R^{11}$, 4 $R^{11}$, 5 $R^{11}$, 6 $R^{11}$, 7 $R^{11}$, 8 $R^{11}$, 9 $R^{11}$, 10 $R^{11}$, 11 $R^{11}$, or 12 $R^{11}$). In some embodiments, $R^{10}$ is $C_1$-$C_6$ heteroalkyl, —N($R^C$)($R^D$) or —N($R^C$)C(O)$R^A$. In some embodiments, $R^{10}$ is $C_1$-$C_6$ heteroalkyl (e.g., $CH_2$NHC(O)$CH_2$), —N($R^C$)($R^D$) (e.g., $NH_2$), or —N($R^C$)C(O)$R^A$ (e.g., NHC(O)$CH_3$).

In some embodiments, each $R^4$ is independently $C_1$-$C_6$ alkyl, $C_2$-$C_6$ alkenyl, $C_2$-$C_6$ alkynyl, $C_1$-$C_6$ heteroalkyl, halo, cyano, oxo, C(O)$R^A$, —C(O)O$R^B$, O$R^B$, —N($R^C$)($R^D$), —C(O)N($R^C$)($R^D$), —N($R^C$)C(O)$R^A$, S(O)$_x R^E$, —S(O)$_x$N($R^C$)($R^D$), —N($R^C$)S(O)$_x R^E$, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with 1-12 $R^7$ (e.g., 1 $R^7$, 2 $R^7$, 3 $R^7$, 4 $R^7$, 5 $R^7$, 6 $R^7$, 7 $R^7$, 8 $R^7$, 9 $R^7$, 10 $R^7$, 11 $R^7$, or 12 $R^7$).

In some embodiments, each $R^{11}$ is independently $C_1$-$C_6$ alkyl, halo, oxo, cyano, —O$R^B$, —N($R^C$)($R^D$), —C(O)N($R^C$)($R^D$), —N($R^C$)C(O)$R^A$, aryl, or heteroaryl, wherein each aryl and heteroaryl is independently and optionally substituted with 1-6 $R^8$ (e.g., 1 $R^8$, 2 $R^8$, 3 $R^8$, 4 $R^8$, 5 $R^8$, or 6 $R^8$).

In some embodiments, each L is independently $C_1$-$C_6$ alkyl, $C_2$-$C_6$ alkenyl, $C_2$-$C_6$ alkynyl, $C_1$-$C_6$ heteroalkyl, —C(O)$R^{A1}$, —C(O)O$R^{B1}$, —O$R^{B1}$, —N($R^{C1}$)($R^{D1}$), —C(O)N($R^{C1}$)($R^{D1}$), N($R^{C1}$)C(O)$R^{A1}$, —S(O)$_x R^{E1}$, —S(O)$_x$ N($R^{C1}$)($R^{D1}$), or —N($R^{C1}$)S(O)$_x R^{E1}$, wherein each alkyl, alkenyl, alkynyl, and heteroalkyl is independently and optionally substituted with 1-12 $R^{12}$ (e.g., 1 $R^{12}$, 2 $R^{12}$, 3 $R^{12}$, 4 $R^{12}$, 5 $R^{12}$, 6 $R^{12}$, 7 $R^{12}$, 8 $R^{12}$, 9 $R^{12}$, 10 $R^{12}$, 11 $R^{12}$, or 12 $R^{12}$).

In some embodiments, each of $R^{A1}$, $R^{B1}$, $R^{C1}$, $R^{D1}$, and $R^{E1}$ is independently hydrogen, $C_1$-$C_6$ alkyl, $C_2$-$C_6$ alkenyl, $C_2$-$C_6$ alkynyl, $C_1$-$C_6$ heteroalkyl, carbocyclyl, heterocyclyl, aryl, or heteroaryl, wherein each alkyl, alkenyl, alkynyl, heteroalkyl, carbocyclyl, heterocyclyl, aryl, and heteroaryl is independently and optionally substituted with 1-12 $R^{12}$ (e.g., 1 $R^{12}$, 2 $R^{12}$, 3 $R^{12}$, 4 $R^{12}$, 5 $R^{12}$, 6 $R^{12}$, 7 $R^{12}$, 8 $R^{12}$, 9 $R^{12}$, 10 $R^{12}$, 11 $R^{12}$, or 12 $R^{12}$).

In an embodiment, X is O. In an embodiment, $R^1$ is heterocyclyl (e.g., piperidine-2,6-dionyl). In an embodiment, each of $R^{2a}$ and $R^{2b}$ is independently hydrogen. In an embodiment, n is 1. In an embodiment, $R^{10}$ is —N($R^C$)($R^D$) (e.g., —NH$_2$). In an embodiment, the degradation compound comprises lenalidomide, e.g., 3-(4-amino-1-oxoisoindolin-2-yl)piperidine-2,6-dione, or a pharmaceutically acceptable salt thereof. In an embodiment, the degradation compound is lenalidomide, e.g., according to the following formula:

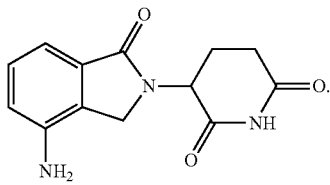 [SMILES: Nc1cccc2c1CN(C1CCC(=O)NC1=O)C2=O]

In an embodiment, X is O. In an embodiment, $R^1$ is heterocyclyl (e.g., piperidinyl-2,6-dionyl). In some embodiments, $R^{2a}$ and $R^{2b}$ together with the carbon to which they are attached form a carbonyl group. In an embodiment, n is 1. In an embodiment, $R^{10}$ is —N($R^C$)($R^D$) (e.g., —NH$_2$). In an embodiment, the degradation compound comprises pomalidomide, e.g., 4-amino-2-(2,6-dioxopiperidin-3-yl)isoindoline-1,3-dione, or a pharmaceutically acceptable salt thereof. In an embodiment, the degradation compound is pomalidomide, e.g., according to the following formula:

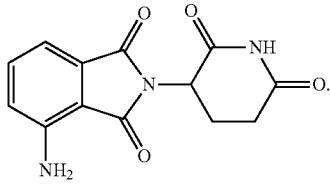 [SMILES: Nc1cccc2c1C(=O)N(C1CCC(=O)NC1=O)C2=O]

In an embodiment, X is O. In an embodiment, $R^1$ is heterocyclyl (e.g., piperidinyl-2,6-dionyl). In an embodiment, $R^{2a}$ and $R^{2b}$ together with the carbon to which they are attached form a carbonyl group. In an embodiment, n is 0. In an embodiment, the degradation compound comprises thalidomide, e.g., 2-(2,6-dioxopiperidin-3-yl)isoindoline-1,3-dione, or a pharmaceutically acceptable salt thereof. In an embodiment, the degradation product is thalidomide, e.g., according to the following formula:

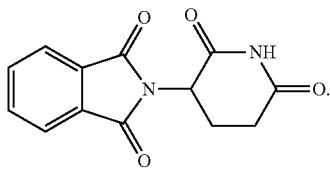 [SMILES: O=C1CCC(N2C(=O)c3ccccc3C2=O)C(=O)N1]

In an embodiment, X is O. In an embodiment, $R^1$ is heterocyclyl (e.g., piperidine-2,6-dionyl). In an embodiment, each of $R^{2a}$ and $R^{2b}$ is independently hydrogen. In an embodiment, n is 1. In an embodiment, $R^{10}$ is $C_1$-$C_6$ heteroalkyl (e.g., CH$_2$NHC(O)CH$_2$-phenyl-t-butyl). In an embodiment, the degradation compound comprises 2-(4-(tert-butyl)phenyl)-N-((2-(2,6-dioxopiperidin-3-yl)-1-oxoisoindolin-5-yl)methyl)acetamide, or a pharmaceutically acceptable salt thereof. In an embodiment, the degradation compound has the structure as shown in the following formula:

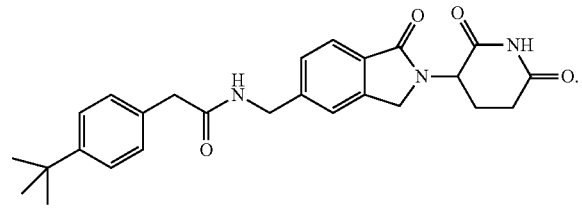 [SMILES: CC(C)(C)c1ccc(CC(=O)NCc2ccc3c(c2)CN(C2CCC(=O)NC2=O)C3=O)cc1]

In some embodiments, the degradation compound (e.g., a compound of Formula (II)) is not attached to a linker or attachment group. In some embodiments, the degradation compound (e.g., a compound of Formula (II)) does not comprise another moiety, e.g., a ligand, a targeting agent, or a moiety capable of dimerization. In some embodiments, $R^{10}$ is not L-Tag.

In some embodiments, the degradation compound (e.g., a compound of Formula (II)) is attached to a linker or attachment group (e.g., at least one $R^{10}$ is L-Tag). In some embodiments, the degradation compound (e.g., a compound of Formula (II)) comprises another moiety, e.g., a ligand, a targeting agent, or a moiety capable of dimerization. In some embodiments, $R^{10}$ is L-Tag, and L is alkyl or heteroalkyl (e.g., a PEG chain). In some embodiments, L is a linker selected from a linker disclosed in International Patent Publication No. WO2017/024318 (e.g., FIGS. 28-31).

In some embodiments, $R^{10}$ is L-Tag, and Tag is a targeting moiety that is capable of binding or is bound to a target protein. A Tag may comprise a small molecule compound or an amino acid sequence (e.g., a peptide or polypeptide). In some embodiments, the Tag is a kinase inhibitor, a BET bromodomain-containing protein inhibitor, cytosolic signaling protein FKBP12 ligand, an HDAC inhibitor, a lysine methyltransferase inhibitor, an angiogenesis inhibitor, an immunosuppressive compound, or an aryl hydrocarbon receptor (AHR) inhibitor.

In certain embodiments, the Tag is a SERM (selective estrogen receptor modulator) or SERD (selective estrogen receptor degrader). Non-limiting examples of SERMs and SERDs are provided in International Patent Publication Nos. WO2014/191726, WO2013/090921, WO2014/203129, WO2014/205136, WO2014/205138, and WO 2014/203132; U.S. Patent Publication Nos. US2013/0178445 and US 2015/0005286; and U.S. Pat. Nos. 9,078,871, 8,853,423, and 8,703,810. Additional Tags include, for example, any moiety which binds to an endogenous protein (binds to a target protein). Exemplary Tags include Hsp90 inhibitors, kinase inhibitors, HDM2 and MDM2 inhibitors, compounds targeting human BET bromodomain-containing proteins, HDAC inhibitors, human lysine methyltransferase inhibitors, angiogenesis inhibitors, nuclear hormone receptor compounds, immunosuppressive compounds, and compounds targeting the aryl hydrocarbon receptor (AHR), among numerous others. Such small molecule Tags also include pharmaceutically acceptable salts, enantiomers, solvates and polymorphs of these compositions, as well as other small molecules that may bind to a target protein of interest.

In an embodiment, the Tag is an Ubc9 SUMO E2 ligase 5F6D targeting ligand, e.g., as described in Hewitt, W. M., et. al. (2016) *Angew. Chem. Int. Ed. Engl.* 55: 5703-5707

In an embodiment, the Tag is a Tank1 targeting ligand, e.g., as described in Kirby, C. A. et al, (2012) *Acta Crystallogr. Sect.F* 68: 115-118; and Shultz, M. D., et al. (2013) *J. Med. Chem.* 56: 7049-7059.

In an embodiment, the Tag is an SH2 domain of pp60 Src targeting ligand, e.g., as described in Gudrun Lange, et al., (2003) *J. Med. Chem.* 46, 5184-5195.

In an embodiment, the Tag is a Sec7 domain targeting ligand, e.g., as described in Huta, B. P., et al., (2016) *Chemmedchem* 11: 277.

In an embodiment, the Tag is a Saposin-B targeting ligand, e.g., as described in I. Nemcovicova and D. M. Zajonc *Acta Cryst.* (2014). D70, 851-862.

In an embodiment, the Tag is a protein S100-A7 2OWS targeting ligand, e.g., as described in Leon, R., Murray, et al., (2009) *Biochemistry* 48: 10591-10600.

In an embodiment, the Tag is a Phospholipase A2 targeting ligand, e.g., as described in Schevitz, R. W., et al., (1995) *Nat. Struct. Biol.* 2, 458-465.

In an embodiment, the Tag is a PHIP targeting ligand, e.g., as described in Krojer, T.; et al. *J. Chem. Sci.* 2016, 7, 2322-2330.

In an embodiment, the Tag is a PDZ targeting ligand, e.g., as described in Mangesh Joshi, et al. *Angew. Chem. Int. Ed.* (2006) 45, 3790-3795.

In an embodiment, the Tag is a PARP15 targeting ligand, e.g., as described in Karlberg, T., et al., (2015) *J. Biol. Chem.* 290: 7336-7344.

In an embodiment, the Tag is a PARP14 targeting ligand, e.g., as described in Andersson, C. D., et al., (2012) *J. Med. Chem.* 55: 7706-7718; Wahlberg, E., et al. (2012) *Nat. Biotechnol.* 30: 283-288; Andersson, C. D., et al. (2012) J. Med. Chem. 55: 7706-7718.

In an embodiment, the Tag is a MTH1 targeting ligand, e.g., as described in Helge Gad, et. al. *Nature*, (2014) 508, 215-221.

In an embodiment, the Tag is a mPGES-1 targeting ligand, e.g., as described in Luz, J. G., et al., (2015) *J. Med. Chem.* 58: 4727-4737.

In an embodiment, the Tag is a FLAP-5-lipoxygenase-activating protein targeting ligand, e.g., as described Ferguson, A. D., et al (2007) *Science* 317: 510-512.

In an embodiment, the Tag is a FA Binding Protein targeting ligand, e.g., as described in Kuhn, B.; et al. *J. Med. Chem.* (2016) 59, 4087-4102.

In an embodiment, the Tag is a BCL2 targeting ligand, e.g., as described in Souers, A. J., et al. (2013) *Nat Med* 19: 202-208.

In an embodiment, the Tag is any small molecule or protein which can bind to a target protein and acted on or degraded by a ubiquitin ligase is a target protein. In some embodiments, the Tag is a dTAG Targeting Ligand disclosed in International Patent Publication No. WO2017/024318 (e.g., Table T, pages 119-129).

When $R^{10}$ is L-Tag, Tag is capable of binding to or is bound to a target protein. Exemplary target proteins include FK506 binding protein-12 (FKBP12), bromodomain-containing protein 4 (BRD4), CREB binding protein (CREBBP), or transcriptional activator BRG1 (SMARCA4). In some embodiments, the target protein comprises a hormone receptor e.g., estrogen-receptor protein, androgen receptor protein, retinoid x receptor (RXR) protein, or dihydrofolate reductase (DHFR), including bacterial DHFR. In some embodiments, the target protein comprises an amino acid sequence derived from a bacterial dehalogenase. In other embodiments, the target protein comprises amino acid sequences derived from 7,8-dihydro-8-oxoguanin triphosphatase, AFAD, Arachidonate 5-lipoxygenase activating protein, apolipoprotein, ASH1L, ATAD2, baculoviral IAP repeat-containing protein 2, BAZ1A, BAZ1B, BAZ2A, BAZ2B, Bcl-2, Bcl-xL, BRD1, BRD2, BRD3, BRD4, BRD5, BRD6, BRD7, BRD8, BRD9, BRD10, BRDT, BRPF1, BRPF3, BRWD3, CD209, CECR2, CREBBP, E3 ligase XIAP, EP300, FALZ, fatty acid binding protein from adipocytes 4 (FABP4), GCN5L2, GTPase k-RAS, HDAC6, hematopoietic prostaglandin D synthase, KIAA1240, lactoylglutathione lyase, LOC93349, Mcl-1, MLL, PA2GA, PB1, PCAF, peptidyl-prolyl cis-trans isomerase NIMA-interacting 1, PHIP, poly-ADP-ribose polymerase 14, poly-ADP-ribose polymerase 15, PRKCBP1, prosaposin, prostaglandin E synthase, retinal rod rhodopsin-sensitive cGMP 3',5'-cyclic phosphodiesterase subunit delta, S100-A7, SMARCA2, SMARCA4, SP100, SP110, SP140, Src, Sumo-conjugating enzyme UBC9, superoxide dismutase, TAF1, TAF1L, tankyrase 1, tankyrase 2, TIFla, TRIM28, TRIM33, TRIM66, WDR9, ZMYND11, or MLL4. In other embodiments, the target protein comprises an amino acid sequence derived from MDM2. In some embodiments, the target protein is a dTAG disclosed in International Patent Publication No. WO2017/024318 (e.g., pages 112-114).

In one embodiment, the target protein is derived from BRD2, BRD3, BRD4, or BRDT. In one embodiment, the target protein is a modified or mutant BRD2, BRD3, BRD4, or BRDT protein. In certain embodiments, the one or more mutations of BRD2 include a mutation of the Tryptophan (W) at amino acid position 97, a mutation of the Valine (V) at amino acid position 103, a mutation of the Leucine (L) at amino acid position 110, a mutation of the W at amino acid position 370, a mutation of the V at amino acid position 376, or a mutation of the L at amino acid position 381.

In one embodiment, the target protein is derived from cytosolic signaling protein FKBP12. In certain embodiments, the target protein is a modified or mutant cytosolic signaling protein FKBP12. In certain embodiments, the modified or mutant cytosolic signaling protein FKBP12 contains one or more mutations that create an enlarged binding pocket for FKBP12 ligands. In certain embodiments, the one or more mutations include a mutation of the phenylalanine (F) at amino acid position 36 to valine (V) (F36V) (referred to interchangeably herein as FKBP12* or FKBP*).

In some embodiments, the degradation compound is a compound disclosed in U.S. Pat. Nos. 7,973,057; 8,546,430; 8,716,315; International Patent Publication No. WO2017/059062; or International Patent Publication No. WO2017/024318; each of which is hereby incorporated by reference in its entirety.

Heterologous Polypeptides

Provided herein are fusion polypeptides including a COF1/CRBN-, COF2/CRBN-, or COF3/CRBN-binding polypeptide and a heterologous polypeptide of interest. In some embodiments, the COF1/CRBN-, COF2/CRBN-, or COF3/CRBN-binding polypeptide and the heterologous polypeptide are separated by a linker (e.g., a glycine-serine linker). In some embodiments, the fusion polypeptide described herein comprises three elements: a COF1/CRBN-, COF2/CRBN-, or COF3/CRBN-binding polypeptide (e.g., a portion of an amino acid sequence of a degron as described herein), a heterologous polypeptide, and a linker separating the COF1/CRBN-, COF2/CRBN-, or COF3/CRBN-binding polypeptide and the heterologous polypeptide. In other embodiments, the fusion polypeptide described herein comprises two elements: a COF1/CRBN-, COF2/CRBN-, or COF3/CRBN-binding polypeptide (e.g., a portion of an amino acid sequence of a degron, e.g., as described herein) linked directly to a heterologous polypeptide. These elements can be arranged such that the COF1/CRBN-, COF2/CRBN-, or COF3/CRBN-binding polypeptide (e.g., a portion of an amino acid sequence of a degron, e.g., as described herein) is located at the N-terminus of the heterologous polypeptide of interest, at the C-terminus of the heterologous polypeptide of interest, or in the middle of the heterologous polypeptide of interest. In one embodiment, the heterologous polypeptide is a cytosolic and/or nuclear protein and the COF1/CRBN-, COF2/CRBN-, or COF3/CRBN-binding polypeptide is located N-terminal to the heterologous polypeptide. In one embodiment, the heterologous polypeptide is a transmembrane protein and the COF1/CRBN-, COF2/CRBN-, or COF3/CRBN-binding polypeptide is located C-terminal to the heterologous polypeptide.

In some embodiments, the fusion polypeptide further comprises a degradation domain. In some embodiments, the degradation domain is separated from the COF1/CRBN-, COF2/CRBN-, or COF3/CRBN-binding polypeptide and the heterologous polypeptide by a heterologous protease cleavage site.

The fusion polypeptides disclosed herein can include any heterologous polypeptide of interest. In some embodiments, the heterologous polypeptide can be a transmembrane protein (e.g., a transmembrane receptor). In certain embodiments, the heterologous polypeptide of interest can be, e.g., an ion channel-linked receptor, an enzyme-linked receptor (e.g., receptor tyrosine kinase, a tyrosine kinase associated receptor, a receptor-like tyrosine phosphatase, a receptor serine/threonine kinase; a receptor guanylyl cyclase, and a histidine kinase associated receptor), or a G protein coupled receptor. In some embodiments, the transmembrane protein is a chimeric antigen receptor, e.g., as described herein.

In another embodiment, the heterologous polypeptide is a secreted protein (e.g., a small secreted protein). In some embodiments, the heterologous polypeptide can be, e.g., an antibody, a nanobody, or a protein binding molecule in cell manufacturing. In some embodiments, the heterologous polypeptide can be a therapeutic or clinical protein (e.g., insulin, growth hormone, erythropoietin, or a therapeutic antibody). In certain embodiments, the protein can be toxic to a cell for manufacturing (e.g., bacterial toxins and proteases).

Table 2 includes a list of exemplary heterologous polypeptide for use in the fusion polypeptides disclosed herein. Additional heterologous polypeptide of interest include Chimeric Antigen T Cell Receptors as described in the section below.

TABLE 2

Heterologous Polypeptides of Interest

| Cytoplasmic or Nuclear | Transmembrane | Secreted |
| --- | --- | --- |
| Apoptosis pathway (e.g., Caspase 9) | CD62E | IL-12 p35 |
| TALENs | CCR1 | IL-12 p40 |
| ZFN | CCR2 | IL-12 p70 |
| Meganuclease | CCR5 | IL-15 or IL-15 complex |
| Cas9 | CCR7 | IL-2 |
| MITF | CCR10 | IL-7 |
| MYC | CXCR2 | IL-18 |
| STAT3 | CXCR3 | IL-9 |
| STAT5 | CXCR4 | IL-21 |
| NF-kappaB | CXCR6 | RANTES/CCL5 |
| Beta-catenin | CTLA4 | CCL2 |
| Notch | PD1 | CCL1 |
| GLI | BTLA | CCL22 |
| c-JUN | VISTA | Heparanase |
| Tet methylcytosine dioxygenase 2 (TET2) | CD137L | matrix metalloproteinase (MMP) |
| FKBP | CD80 | Cathepsin |
| Tau | CD86 | Antibody (e.g., anti-tumor antibody, e.g., Herceptin, or a checkpoint inhibitor antibody, e.g., anti-PD1 antibody) |
| Enzyme | TIGIT | Peptide (e.g., anti-tumor peptide, or protein hormone) |
| Scaffold protein | Chimeric Antigen Receptor (e.g., CAR that binds to CD19, CD22, CD20, BCMA, CD123, CD33, EGFRvIII, or Mesothelin) | IL-6 inhibitory peptide |
|  | CD3 | TGFbeta inhibitory peptide |
|  | CD8 |  |
|  | CD19 |  |
|  | CD22 |  |
|  | CD20 |  |
|  | BCMA |  |

CAR Antigen Binding Domain

In one aspect, the CAR of the disclosure linked to a COF1/CRBN-, COF2/CRBN-, or COF3/CRBN-binding polypeptide and/or a degradation domain comprises a target-specific binding element otherwise referred to as an antigen binding domain. In one embodiment, the portion of the CAR comprising the antigen binding domain comprises an antigen binding domain that targets, e.g., specifically binds to, an antigen, e.g., antigen described herein, e.g., CD19. In one embodiment, the antigen binding domain targets, e.g., specifically binds to, human CD19.

In some embodiments, the heterologous polypeptide linked to a COF1/CRBN-, COF2/CRBN-, or COF3/CRBN-binding polypeptide and/or a degradation domain comprises a chimeric antigen receptor (CAR). In some embodiments, the CAR comprises an antigen binding domain (e.g., an antibody or antibody fragment, a TCR, or a TCR fragment) that binds to a tumor antigen, a transmembrane domain, and an intracellular signaling domain (e.g., an intracellular signaling domain comprising a costimulatory domain) and/or a primary signaling domain. CAR nucleic acid constructs, encoded proteins, containing vectors, host cells, pharmaceutical compositions, and methods of administration and treatment related to the present disclosure are disclosed in detail in International Patent Application Publication No. WO2015142675, which is incorporated by reference in its entirety.

In some embodiments, the heterologous polypeptide is a chimeric antigen receptor (CAR), wherein the CAR comprises an antigen binding domain (e.g., antibody or antibody fragment, TCR or TCR fragment) that binds to a tumor-supporting antigen (e.g., a tumor-supporting antigen as described herein), a transmembrane domain (e.g., a transmembrane domain described herein), and an intracellular signaling domain (e.g., an intracellular signaling domain described herein) (e.g., an intracellular signaling domain comprising a costimulatory domain (e.g., a costimulatory domain described herein) and/or a primary signaling domain (e.g., a primary signaling domain described herein). In some embodiments, the tumor-supporting antigen is an antigen present on a stromal cell or a myeloid-derived suppressor cell (MDSC). In other aspects, the invention features polypeptides encoded by such nucleic acids and host cells containing such nucleic acids and/or polypeptides.

In some embodiments, a CAR molecule comprises at least one intracellular signaling domain selected from a CD137 (4-1BB) signaling domain, a CD28 signaling domain, a CD27 signaling domain, an ICOS signaling domain, a CD3zeta signal domain, or any combination thereof. In some embodiments, a CAR molecule comprises at least one intracellular signaling domain selected from one or more costimulatory molecule(s) selected from CD137 (4-1BB), CD28, CD27, or ICOS.

In some embodiments, a plurality of immune effector cells, e.g., the population of T regulatory-depleted cells, include a nucleic acid encoding a CAR that comprises a target-specific binding element otherwise referred to as an antigen binding domain. The choice of binding element depends upon the type and number of ligands that define the surface of a target cell. For example, the antigen binding domain may be chosen to recognize a ligand that acts as a cell surface marker on target cells associated with a particular disease state. Thus, examples of cell surface markers that may act as ligands for the antigen binding domain in a CAR described herein include those associated with viral, bacterial and parasitic infections, autoimmune disease and cancer cells.

Sequences of non-limiting examples of various components that can be part of a CAR molecule, e.g., a TA CAR or a BCA CAR described herein, are listed in Table 3, where "aa" stands for amino acids, and "na" stands for nucleic acids that encode the corresponding peptide.

TABLE 3

Sequences of various components of CAR (aa - amino acid sequence, na - nucleic acid sequence).

| SEQ ID NO: | description | Sequence |
|---|---|---|
| SEQ ID NO: 144 | EF-1 promoter (na) | CGTGAGGCTCCGGTGCCCGTCAGTGGGCAGAGCGCACATC GCCCACAGTCCCCGAGAAGTTGGGGGGAGGGGTCGGCAAT TGAACCGGTGCCTAGAGAAGGTGGCGCGGGGTAAACTGGG AAAGTGATGTCGTGTACTGGCTCCGCCTTTTTCCCGAGGGT GGGGGAGAACCGTATATAAGTGCAGTAGTCGCCGTGAACG TTCTTTTTCGCAACGGGTTTGCCGCCAGAACACAGGTAAGT GCCGTGTGTGGTTCCCGCGGGCCTGGCCTCTTTACGGGTTA TGGCCCTTGCGTGCCTTGAATTACTTCCACCTGGCTGCAGT ACGTGATTCTTGATCCCGAGCTTCGGGTTGGAAGTGGGTGG GAGAGTTCGAGGCCTTGCGCTTAAGGAGCCCCTTCGCCTCG TGCTTGAGTTGAGGCCTGGCCTGGGCGCTGGGGCCGCCGCG TGCGAATCTGGTGGCACCTTCGCGCCTGTCTCGCTGCTTTC GATAAGTCTCTAGCCATTTAAAATTTTTGATGACCTGCTGC GACGCTTTTTTTCTGGCAAGATAGTCTTGTAAATGCGGGCC AAGATCTGCACACTGGTATTTCGGTTTTTGGGGCCGCGGGC GGCGACGGGGCCCGTGCGTCCCAGCGCACATGTTCGGCGA GGCGGGGCCTGCGAGCGCGGCCACCGAGAATCGGACGGGG GTAGTCTCAAGCTGGCCGGCCTGCTCTGGTGCCTGGCCTCG CGCCGCCGTGTATCGCCCCGCCCTGGGCGGCAAGGCTGGCC CGGTCGGCACCAGTTGCGTGAGCGGAAAGATGGCCGCTTC CCGGCCCTGCTGCAGGGAGCTCAAAATGGAGGACGCGGCG CTCGGGAGAGCGGGCGGGTGAGTCACCCACACAAAGGAAA AGGGCCTTTCCGTCCTCAGCCGTCGCTTCATGTGACTCCAC GGAGTACCGGGCGCCGTCCAGGCACCTCGATTAGTTCTCGA GCTTTTGGAGTACGTCGTCTTTAGGTTGGGGGGAGGGGTTT TATGCGATGGAGTTTCCCCACACTGAGTGGGTGGAGACTGA AGTTAGGCCAGCTTGGCACTTGATGTAATTCTCCTTGGAAT TTGCCCTTTTTGAGTTTGGATCTTGGTTCATTCTCAAGCCTC AGACAGTGGTTCAAAGTTTTTTTCTTCCATTTCAGGTGTCGT GA |

TABLE 3-continued

Sequences of various components of CAR (aa - amino acid sequence, na - nucleic acid sequence).

| SEQ ID NO: | description | Sequence |
| --- | --- | --- |
| SEQ ID NO: 64 | Leader (aa) | MALPVTALLLPLALLLHAARP |
| SEQ ID NO: 145 | Leader (na) | ATGGCCCTGCCTGTGACAGCCCTGCTGCTGCCTCTGGCTCT GCTGCTGCATGCCGCTAGACCC |
| SEQ ID NO: 146 | Leader (na) | ATGGCCCTCCCTGTCACCGCCCTGCTGCTTCCGCTGGCTCTT CTGCTCCACGCCGCTCGGCCC |
| SEQ ID NO: 147 | CD 8 hinge (aa) | TTTPAPRPPTPAPTIASQPLSLRPEACRPAAGGAVHTRGLDFAC D |
| SEQ ID NO: 148 | CD8 hinge (na) | ACCACGACGCCAGCGCCGCGACCACCAACACCGGCGCCCA CCATCGCGTCGCAGCCCCTGTCCCTGCGCCCAGAGGCGTGC CGGCCAGCGGCGGGGGGCGCAGTGCACACGAGGGGGCTGG ACTTCGCCTGTGAT |
| SEQ ID NO: 149 | Ig4 hinge (aa) | ESKYGPPCPPCPAPEFLGGPSVFLFPPKPKDTLMISRTPEVTCV VVDVSQEDPEVQFNWYVDGVEVHNAKTKPREEQFNSTYRVV SVLTVLHQDWLNGKEYKCKVSNKGLPSSIEKTISKAKGQPREP QVYTLPPSQEEMTKNQVSLTCLVKGFYPSDIAVEWESNGQPE NNYKTTPPVLDSDGSFFLYSRLTVDKSRWQEGNVFSCSVMHE ALHNHYTQKSLSLSLGKM |
| SEQ ID NO: 150 | Ig4 hinge (na) | GAGAGCAAGTACGGCCCTCCCTGCCCCCCTTGCCCTGCCCC CGAGTTCCTGGGCGGACCCAGCGTGTTCCTGTTCCCCCCCA AGCCCAAGGACACCCTGATGATCAGCCGGACCCCCGAGGT GACCTGTGTGGTGGTGGACGTGTCCCAGGAGGACCCCGAG GTCCAGTTCAACTGGTACGTGGACGGCGTGGAGGTGCACA ACGCCAAGACCAAGCCCCGGGAGGAGCAGTTCAATAGCAC CTACCGGGTGGTGTCCGTGCTGACCGTGCTGCACCAGGACT GGCTGAACGGCAAGGAATACAAGTGTAAGGTGTCCAACAA GGGCCTGCCCAGCAGCATCGAGAAAACCATCAGCAAGGCC AAGGGCCAGCCTCGGGAGCCCCAGGTGTACACCCTGCCCC CTAGCCAAGAGGAGATGACCAAGAACCAGGTGTCCCTGAC CTGCCTGGTGAAGGGCTTCTACCCCAGCGACATCGCCGTGG AGTGGGAGAGCAACGGCCAGCCCGAGAACAACTACAAGAC CACCCCCCCTGTGCTGGACAGCGACGGCAGCTTCTTCCTGT ACAGCCGGCTGACCGTGGACAAGAGCCGGTGGCAGGAGGG CAACGTCTTTAGCTGCTCCGTGATGCACGAGGCCCTGCACA ACCACTACACCCAGAAGAGCCTGAGCCTGTCCCTGGGCAA GATG |
| SEQ ID NO: 151 | IgD hinge (aa) | RWPESPKAQASSVPTAQPQAEGSLAKATTAPATTRNTGRGGE EKKKEKEKEEQEERETKTPECPSHTQPLGVYLLTPAVQDLWL RDKATFTCFVVGSDLKDAHLTWEVAGKVPTGGVEEGLLERH SNGSQSQHSRLTLPRSLWNAGTSVTCTLNHPSLPPQRLMALRE PAAQAPVKLSLNLLASSDPPEAASWLLCEVSGFSPPNILLMWL EDQREVNTSGFAPARPPPQPGSTTFWAWSVLRVPAPPSPQPAT YTCVVSHEDSRTLLNASRSLEVSYVTDH |
| SEQ ID NO: 152 | IgD hinge (na) | AGGTGGCCCGAAAGTCCCAAGGCCCAGGCATCTAGTGTTC CTACTGCACAGCCCCAGGCAGAAGGCAGCCTAGCCAAAGC TACTACTGCACCTGCCACTACGCGCAATACTGGCCGTGGCG GGGAGGAGAAGAAAAAGGAGAAAGAGAAAGAAGAACAG GAAGAGAGGGAGACCAAGACCCCTGAATGTCCATCCCATA CCCAGCCGCTGGGCGTCTATCTCTTGACTCCCGCAGTACAG GACTTGTGGCTTAGAGATAAGGCCACCTTTACATGTTTCGT CGTGGGCTCTGACCTGAAGGATGCCCATTTGACTTGGGAGG TTGCCGGAAAGGTACCCACAGGGGGGGTTGAGGAAGGGTT GCTGGAGCGCCATTCCAATGGCTCTCAGAGCCAGCACTCAA GACTCACCCTTCCGAGATCCCTGTGGAACGCCGGGACCTCT GTCACATGTACTCTAAATCATCCTAGCCTGCCCCCACAGCG TCTGATGGCCCTTAGAGAGCCAGCCGCCCAGGCACCAGTTA AGCTTAGCCTGAATCTGCTCGCCAGTAGTGATCCCCCAGAG GCCGCCAGCTGGCTCTTATGCGAAGTGTCCGGCTTTAGCCC GCCCAACATCTTGCTCATGTGGCTGGAGGACCAGCGAGAA GTGAACACCAGCGGCTTCGCTCCAGCCCGGCCCCCACCCCA GCCGGGTTCTACCACATTCTGGGCCTGGAGTGTCTTAAGGG TCCCAGCACCACCTAGCCCCCAGCCAGCCACATACACCTGT GTTGTGTCCCATGAAGATAGCAGGACCCTGCTAAATGCTTC TAGGAGTCTGGAGGTTTCCTACGTGACTGACCATT |

TABLE 3-continued

Sequences of various components of CAR (aa - amino acid sequence, na - nucleic acid sequence).

| SEQ ID NO: | description | Sequence |
|---|---|---|
| SEQ ID NO: 153 | GS hinge/linker (aa) | GGGGSGGGGS |
| SEQ ID NO: 154 | GS hinge/linker (na) | GGTGGCGGAGGTTCTGGAGGTGGAGGTTCC |
| SEQ ID NO: 155 | CD8TM (aa) | IYIWAPLAGTCGVLLLSLVITLYC |
| SEQ ID NO: 156 | CD8 TM (na) | ATCTACATCTGGGCGCCCTTGGCCGGGACTTGTGGGGTCCTTCTCCTGTCACTGGTTATCACCCTTTACTGC |
| SEQ ID NO: 157 | CD8 TM (na) | ATCTACATTTGGGCCCCTCTGGCTGGTACTTGCGGGGTCCTGCTGCTTTCACTCGTGATCACTCTTTACTGT |
| SEQ ID NO: 158 | 4-1BB intracellular domain (aa) | KRGRKKLLYIFKQPFMRPVQTTQEEDGCSCRFPEEEEGGCEL |
| SEQ ID NO: 159 | 4-1BB intracellular domain (na) | AAACGGGGCAGAAAGAAACTCCTGTATATATTCAAACAACCATTTATGAGACCAGTACAAACTACTCAAGAGGAAGATGGCTGTAGCTGCCGATTTCCAGAAGAAGAAGAAGGAGGATGTGAACTG |
| SEQ ID NO: 160 | 4-1BB intracellular domain (na) | AAGCGCGGTCGGAAGAAGCTGCTGTACATCTTTAAGCAACCCTTCATGAGGCCTGTGCAGACTACTCAAGAGGAGGACGGCTGTTCATGCCGGTTCCCAGAGGAGGAGGAAGGCGGCTGCGAACTG |
| SEQ ID NO: 161 | CD27 (aa) | QRRKYRSNKGESPVEPAEPCRYSCPREEEGSTIPIQEDYRKPEPACSP |
| SEQ ID NO: 162 | CD27 (na) | AGGAGTAAGAGGAGCAGGCTCCTGCACAGTGACTACATGAACATGACTCCCCGCCGCCCCGGGCCCACCCGCAAGCATTACCAGCCCTATGCCCCACCACGCGACTTCGCAGCCTATCGCTCC |
| SEQ ID NO: 163 | CD3-zeta (aa) | RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 164 | CD3-zeta (na) | AGAGTGAAGTTCAGCAGGAGCGCAGACGCCCCCGCGTACAAGCAGGGCCAGAACCAGCTCTATAACGAGCTCAATCTAGGACGAAGAGAGGAGTACGATGTTTTGGACAAGAGACGTGGCCGGGACCCTGAGATGGGGGGAAAGCCGAGAAGGAAGAACCCTCAGGAAGGCCTGTACAATGAACTGCAGAAAGATAAGATGGCGGAGGCCTACAGTGAGATTGGGATGAAAGGCGAGCGCCGGAGGGGCAAGGGGCACGATGGCCTTTACCAGGGTCTCAGTACAGCCACCAAGGACACCTACGACGCCCTTCACATGCAGGCCCTGCCCCCTCGC |
| SEQ ID NO: 165 | CD3-zeta (na) | CGCGTGAAATTCAGCCGCAGCGCAGATGCTCCAGCCTACAAGCAGGGGCAGAACCAGCTCTACAACGAACTCAATCTTGGTCGGAGAGAGGAGTACGACGTGCTGGACAAGCGGAGAGGACGGGACCCAGAAATGGGCGGGAAGCCGCGCAGAAAGAATCCCCAAGAGGGCCTGTACAACGAGCTCCAAAAGGATAAGATGGCAGAAGCCTATAGCGAGATTGGTATGAAGGGGAACGCAGAAGAGGCAAAGGCCACGACGGACTGTACCAGGGACTCAGCACCGCCACCAAGGACACCTATGACGCTCTTCACATGCAGGCCCTGCCGCCTCGG |
| SEQ ID NO: 166 | CD3-zeta (aa) | RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 167 | CD3-zeta (na) | AGAGTGAAGTTCAGCAGGAGCGCAGACGCCCCCGCGTACCAGCAGGGCCAGAACCAGCTCTATAACGAGCTCAATCTAGGACGAAGAGAGGAGTACGATGTTTTGGACAAGAGACGTGGCCGGGACCCTGAGATGGGGGGAAAGCCGAGAAGGAAGAACCCTCAGGAAGGCCTGTACAATGAACTGCAGAAAGATAAGATGGCGGAGGCCTACAGTGAGATTGGGATGAAAGGCGAGCGCCGGAGGGGCAAGGGGCACGATGGCCTTTACCAGGGTCTC |

TABLE 3-continued

Sequences of various components of CAR (aa - amino acid sequence, na - nucleic acid sequence).

| SEQ ID NO: | description | Sequence |
|---|---|---|
| | | AGTACAGCCACCAAGGACACCTACGACGCCCTTCACATGC<br>AGGCCCTGCCCCCTCGC |
| SEQ ID NO: 168 | Linker (aa) | GGGGS |
| SEQ ID NO: 154 | Linker (aa) | GGTGGCGGAGGTTCTGGAGGTGGAGGTTCC |
| SEQ ID NO: 169 | PD-1 extracellular domain (aa) | Pgwfldspdrpwnpptfspallvvtegdnatftcsfsntsesfylnwyrmspsnqtdklaafpe<br>drsqpgqdcrfrvtqlpngrdfhmsvvrarrndsgtylcgaislapkaqikeslraelrvterrae<br>vptahpspsprpagqfqtlv |
| SEQ ID NO: 170 | PD-1 extracellular domain (na) | Cccggatggtttctggactctccggatcgcccgtggaatcccccaaccttctcaccggcactcttg<br>gttgtgactgagggcgataatgcgaccttcacgtgctcgttctccaacacctccgaatcattcgtgct<br>gaactggtaccgcatgagcccgtcaaaccagaccgacaagctcgccgcgtttccggaagatcgg<br>tcgcaaccgggacaggattgtcggttccgcgtgactcaactgccgaatggcagagacttccacat<br>gagcgtggtccgcgctaggcgaaacgactccgggacctacctgtgcggagccatctcgctggcg<br>cctaaggcccaaatcaaagagagcttgagggccgaactgagagtgaccgagcgcagagctgag<br>gtgccaactgcacatccatcccatcgcctcggcctgcggggcagtttcagaccctggtc |
| SEQ ID NO: 171 | PD-1 CAR (aa) with signal | Malpvtalllplalllhaarppgwfldspdrpwnpptfspallvvtegdnatftcsfsntsesfvln<br>wyrmspsnqtdklaafpedrsqpgqdcrfrvtqlpngrdfhmsvvrarrndsgtylcgaislap<br>kaqikeslraelrvterraevptahpspsprpagqfqtlvtttpaprppptpaptiasqplslrpeacr<br>paaggavhtrgldfacdiyiwaplagtcgvlllslvitlyckrgrkkllyiflcqpfmrpvqttqee<br>dgcscrfpeeeeggcelrvkfsrsadapaykqgqnqlynelnlgrreeydvldkrrgrdpemg<br>gkprrknpqeglynelqkdkmaeayseigmkgerrrgkghdglyqglstatkdtydalhmq<br>alppr |
| SEQ ID NO: 172 | PD-1 CAR (na) | Atggcccccctgtcactgccctgcttctcccctcgcactcctgctccacgccgctagaccaccc<br>ggatggtttctggactctccggatcgcccgtgaatcccccaaccttctcaccggcactcttggttgt<br>gactgagggcgataatgcgaccttcacgtgctcgttctccaacacctccgaatcattcgtgctgaac<br>tggtaccgcatgagcccgtcaaaccagaccgacaagctcgccgcgtttccggaagatcggtcgc<br>aaccgggacaggattgtcggttccgcgtgactcaactgccgaatggcagagacttccacatgagc<br>gtggtccgcgctaggcgaaacgactccgggacctacctgtgcggagccatctcgctggcgccta<br>aggcccaaatcaaagagagcttgagggccgaactgagagtgaccgagcgcagagctgaggtg<br>ccaactgcacatccatcccatcgcctcggcctgcggggcagtttcagaccctggtcgctgaggcc<br>tccggcgccgcgcccaccgactccggccccaactatcgcgagccagcccctgtcgctgaggcc<br>ggaagcatgccgccctgccgccggaggtgctgtgcatacccggggattggacttcgcatgcgac<br>atctacatttgggctcctctcgccggaacttgtggcgtgctccttctgtccctggtcatcaccctgtac<br>tgcaagcggggtcggaaaaagcttctgtacatttttcaagcagcccttcatgaggcccgtcaaacc<br>acccaggaggaggacggttgctcctgccggttccccgaagaggaagaaggaggttgcgagctg<br>cgcgtgaagttctcccggagcgccgacgcccccgcctataagcagggccagaaccagctgtac<br>aacgaactgaactgggacggcgggaagagtacgatgtgctggacaagcggcgcggccggga<br>ccccgaaatgggcgggaagcctagaagaaagaaccctcaggaaggcctgtataacgagctgca<br>gaaggacaagatggccgaggcctactccgaaattgggatgaagggagagcggcggagggga<br>aagggcacgacggcctgtaccaaggactgtccaccgccaccaaggacacatacgatgccctgc<br>acatgcaggcccttcccctcgc |
| SEQ ID NO: 173 | Linker (aa) | (Gly-Gly-Gly-Ser)n, where n = 1-10 |
| SEQ ID NO: 141 | Linker (aa) | (Gly4 Ser)4 |
| SEQ ID NO: 142 | Linker (aa) | (Gly4 Ser)3 |
| SEQ ID NO: 143 | Linker (aa) | (Gly3Ser) |
| SEQ ID NO: 174 | polyA (na) | [+]$_{50-5000}$ |
| SEQ ID NO: 175 | PD1 CAR (aa) | Pgwfldspdrpwnpptfspallvvtegdnatftcsfsntsesfvlnwyrmspsnqtdklaafpe<br>drsqpgqdcrfrvtqlpngrdfhmsvvrarrndsgtylcgaislapkaqikeslraelrvterrae<br>vptahpspsprpagqfqtlvtttpaprppptpaptiasqplslrpeacrpaaggavhtrgldfacdiy<br>iwaplagtcgvlllslvitlyckrgrkkllyifkqpfmrpvqttqeedgcscrfpeeeeggcelrv<br>kfsrsadapaykqgqnqlynelnlgrreeydvldkrrgrdpemggkprrknpqeglynelqk<br>dkmaeayseigmkgerrrgkghdglyqglstatkdtydalhmqalppr |

TABLE 3-continued

Sequences of various components of CAR (aa - amino acid sequence, na - nucleic acid sequence).

| SEQ ID NO: | description | Sequence |
|---|---|---|
| SEQ ID NO: 176 | ICOS intracellular domain (aa) | TKKKYSSSVHDPNGEYMFMRAVNTAKKSRLTDVTL |
| SEQ ID NO: 177 | ICOS intracellular domain (na) | ACAAAAAAGAAGTATTCATCCAGTGTGCACGACCCTAACGGTGAATACATGTTCATGAGAGCAGTGAACACAGCCAAAAAATCCAGACTCACAGATGTGACCCTA |
| SEQ ID NO: 178 | ICOS TM domain (aa) | TTTPAPRPPTPAPTIASQPLSLRPEACRPAAGGAVHTRGLDFACDFWLPIGCAAFVVVCILGCILICWL |
| SEQ ID NO: 179 | ICOS TM domain (na) | ACCACGACGCCAGCGCCGCGACCACCAACACCGGCGCCCACCATCGCGTCGCAGCCCCTGTCCCTGCGCCCAGAGGCGTGCCGGCCAGCGGCGGGGGGCGCAGTGCACACGAGGGGGCTGGACTTCGCCTGTGATTTCTGGTTACCCATAGGATGTGCAGCCTTTGTTGTAGTCTGCATTTTGGGATGCATACTTATTTGTTGGCTT |
| SEQ ID NO: 180 | CD28 intracellular domain (aa) | RSKRSRLLHSDYMNMTPRRPGPTRKHYQPYAPPRDFAAYRS |
| SEQ ID NO: 162 | CD28 intracellular domain (na) | AGGAGTAAGAGGAGCAGGCTCCTGCACAGTGACTACATGAACATGACTCCCCGCCGCCCCGGGCCCACCCGCAAGCATTACCAGCCCTATGCCCCACCACGCGACTTCGCAGCCTATCGCTCC |

TABLE 4

CAR modified with degadation tag and/or FurON

| SEQ ID NO | Description | Amino acid sequences (signal peptide included) |
|---|---|---|
| SEQ ID NO: 64 | Signal peptide (aa) | MALPVTALLLPLALLLHAARP |
| SEQ ID NO: 140 | Modified signal peptide (aa) | MALPVTALLLPLALLLHAARPRSSLA |
| SEQ ID NO: 28 | 16GS linker (aa) | GGGGSGGGGTGGGGSG |
| SEQ ID NO: 99 | 16KGS linker (aa) | KGGGSKGGGTKGGGSK |
| SEQ ID NO: 29 | CAR19 (aa) | MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR |
| SEQ ID NO: 92 | FurON_CAR19 (construct 765)(aa) | MALPVTALLLPLALLLHAARPRSSLALSLTADQMVSALLDAEPPILYSEYDPTRPFSEASMMGLLTNLADRELVHMINWAKRVPGFVDLALHDQVHLLECAWMEILMIGLVWRSMEHPGKLLFAPNLLLDRNQGKCVEGGVEIFDMLLATSSRFMMNLQGEEFVCLKSIILLNSGVYTFLSSTLKSLEEKDHIHRVLDKITDTLIHLMAKAGLTLQQQHQRLAQLLLILSHIRHMSSKRMEHLYSMKCKNVVPLSDLLLEMLDAHRLGTGAEDPRPSRKRRSLGDVGEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSV |

TABLE 4-continued

CAR modified with degradation tag and/or FurON

| SEQ ID NO | Description | Amino acid sequences (signal peptide included) |
|---|---|---|
| | | TAADTAVYYCAKHYYYGGSYAMDYWGQGTLVTVSSTTTP APRPPTPAPTIASQPLSLRPEACRPAAGGAVHTRGLDFACDI YIWAPLAGTCGVLLLSLVITLYCKRGRKKLLYIFKQPFMRPV QTTQEEDGCSCRFPEEEEGGCELRVKFSRSADAPAYQQGQN QLYNELNLGRREEYDVLDKRRGRDPEMGGKPRRKNPQEGL YNELQKDKMAEAYSEIGMKGERRRGKGHDGLYQGLSTAT KDTYDALHMQALPPR |
| SEQ ID NO: 93 | FurON_CAR19_16 GS_HilD tag_V5 (construct 766)(aa) | MALPVTALLLPLALLLHAARPRSSLALSLTADQMVSALLDA EPPILYSEYDPTRPFSEASMMGLLTNLADRELVHMINWAKR VPGFVDLALHDQVHLLECAWMEILMIGLVWRSMEHPGKLL FAPNLLLDRNQGKCVEGGVEIFDMLLATSSRFRMMNLQGE EFVCLKSIILLNSGVYTFLSSTLKSLEEKDHIHRVLDKITDTLI HLMAKAGLTLQQQHQRLAQLLLILSHIRHMSSKRMEHLYS MKCKNVVPLSDLLLEMLDAHRLGTGAEDPRPSRKRRSLGD VGEIVMTQSPATLSLSPGERATLSCRASQDISKYLNWYQQK PGQAPRLLIYHTSRLHSGIPARFSGSGSGTDYTLTISSLQPEDF AVYFCQQGNTLPYTFGQGTKLEIKGGGGSGGGGSGGGGSQ VQLQESGPGLVKPSETLSLTCTVSGVSLPDYGVSWIRQPPGK GLEWIGVIWGSETTYYQSSLKSRVTISKDNSKNQVSLKLSSV TAADTAVYYCAKHYYYGGSYAMDYWGQGTLVTVSSTTTP APRPPTPAPTIASQPLSLRPEACRPAAGGAVHTRGLDFACDI YIWAPLAGTCGVLLLSLVITLYCKRGRKKLLYIFKQPFMRPV QTTQEEDGCSCRFPEEEEGGCELRVKFSRSADAPAYQQGQN QLYNELNLGRREEYDVLDKRRGRDPEMGGKPRRKNPQEGL YNELQKDKMAEAYSEIGMKGERRRGKGHDGLYQGLSTAT KDTYDALHMQALPPRGGGGSGGGGTGGGGSGMHKRSHTG ERPFQCNQCGASFTQKGNLLRHIKLHTGEKPFKCHLCNTAS AEARHIKAEMGGKPIPNPLLGLDST |
| SEQ ID NO: 32 | FurON_CAR19_16 GS_HilD tag (construct 767)(aa) | MALPVTALLLPLALLLHAARPRSSLALSLTADQMVSALLDA EPPILYSEYDPTRPFSEASMMGLLTNLADRELVHMINWAKR VPGFVDLALHDQVHLLECAWMEILMIGLVWRSMEHPGKLL FAPNLLLDRNQGKCVEGGVEIFDMLLATSSRFRMMNLQGE EFVCLKSIILLNSGVYTFLSSTLKSLEEKDHIHRVLDKITDTLI HLMAKAGLTLQQQHQRLAQLLLILSHIRHMSSKRMEHLYS MKCKNVVPLSDLLLEMLDAHRLGTGAEDPRPSRKRRSLGD VGEIVMTQSPATLSLSPGERATLSCRASQDISKYLNWYQQK PGQAPRLLIYHTSRLHSGIPARFSGSGSGTDYTLTISSLQPEDF AVYFCQQGNTLPYTFGQGTKLEIKGGGGSGGGGSGGGGSQ VQLQESGPGLVKPSETLSLTCTVSGVSLPDYGVSWIRQPPGK GLEWIGVIWGSETTYYQSSLKSRVTISKDNSKNQVSLKLSSV TAADTAVYYCAKHYYYGGSYAMDYWGQGTLVTVSSTTTP APRPPTPAPTIASQPLSLRPEACRPAAGGAVHTRGLDFACDI YIWAPLAGTCGVLLLSLVITLYCKRGRKKLLYIFKQPFMRPV QTTQEEDGCSCRFPEEEEGGCELRVKFSRSADAPAYQQGQN QLYNELNLGRREEYDVLDKRRGRDPEMGGKPRRKNPQEGL YNELQKDKMAEAYSEIGMKGERRRGKGHDGLYQGLSTAT KDTYDALHMQALPPRGGGGSGGGGTGGGGSGMHKRSHTG ERPFQCNQCGASFTQKGNLLRHIKLHTGEKPFKCHLCNTAS AEARHIKAEMG |
| SEQ ID NO: 33 | FurON_CAR19_16 GS_HilD tag_NoK (aa) | MALPVTALLLPLALLLHAARPRSSLALSLTADQMVSALLDA EPPILYSEYDPTRPFSEASMMGLLTNLADRELVHMINWAKR VPGFVDLALHDQVHLLECAWMEILMIGLVWRSMEHPGKLL FAPNLLLDRNQGKCVEGGVEIFDMLLATSSRFRMMNLQGE EFVCLKSIILLNSGVYTFLSSTLKSLEEKDHIHRVLDKITDTLI HLMAKAGLTLQQQHQRLAQLLLILSHIRHMSSKRMEHLYS MKCKNVVPLSDLLLEMLDAHRLGTGAEDPRPSRKRRSLGD VGEIVMTQSPATLSLSPGERATLSCRASQDISKYLNWYQQK PGQAPRLLIYHTSRLHSGIPARFSGSGSGTDYTLTISSLQPEDF AVYFCQQGNTLPYTFGQGTKLEIKGGGGSGGGGSGGGGSQ VQLQESGPGLVKPSETLSLTCTVSGVSLPDYGVSWIRQPPGK GLEWIGVIWGSETTYYQSSLKSRVTISKDNSKNQVSLKLSSV TAADTAVYYCAKHYYYGGSYAMDYWGQGTLVTVSSTTTP APRPPTPAPTIASQPLSLRPEACRPAAGGAVHTRGLDFACDI YIWAPLAGTCGVLLLSLVITLYCKRGRKKLLYIFKQPFMRPV QTTQEEDGCSCRFPEEEEGGCELRVKFSRSADAPAYQQGQN QLYNELNLGRREEYDVLDKRRGRDPEMGGKPRRKNPQEGL YNELQKDKMAEAYSEIGMKGERRRGKGHDGLYQGLSTAT KDTYDALHMQALPPRGGGGSGGGGTGGGGSGMHRRSHTG ERPFQCNQCGASFTQRGNLLRHIRLHTGERPFRCHLCNTASA EARHIRAEMG |

TABLE 4-continued

CAR modified with degradation tag and/or FurON

| SEQ ID NO | Description | Amino acid sequences (signal peptide included) |
|---|---|---|
| SEQ ID NO: 94 | CAR19_16GS_HilD tag_V5 (construct 768)(aa) | MALPVTALLLPLALLLHAARPEIVMTQSPATLSLSPGERATL SCRASQDISKYLNWYQQKPGQAPRLLIYHTSRLHSGIPARFS GSGSGTDYTLTISSLQPEDFAVYFCQQGNTLPYTFGQGTKLE IKGGGGSGGGGSGGGGSQVQLQESGPGLVKPSETLSLTCTV SGVSLPDYGVSWIRQPPGKGLEWIGVIWGSETTYYQSSLKS RVTISKDNSKNQVSLKLSSVTAADTAVYYCAKHYYYGGSY AMDYWGQGTLVTVSSTTTPAPRPPTPAPTIASQPLSLRPEAC RPAAGGAVHTRGLDFACDIYIWAPLAGTCGVLLLSLVITLY CKRGRKKLLYIFKQPFMRPVQTTQEEDGCSCRFPEEEEGGC ELRVKFSRSADAPAYQQGQNQLYNELNLGRREEYDVLDKR RGRDPEMGGKPRRKNPQEGLYNELQKDKMAEAYSEIGMK GERRRGKGHDGLYQGLSTATKDTYDALHMQALPPRGGGG SGGGGTGGGGSGMHKRSHTGERPFQCNQCGASFTQKGNLL RHIKLHTGEKPFKCHLCNTASAEARHIKAEMGGKPIPNPLLG LDST |
| SEQ ID NO: 30 | CAR19_16GS_HilD tag (construct 769) (aa) | MALPVTALLLPLALLLHAARPEIVMTQSPATLSLSPGERATL SCRASQDISKYLNWYQQKPGQAPRLLIYHTSRLHSGIPARFS GSGSGTDYTLTISSLQPEDFAVYFCQQGNTLPYTFGQGTKLE IKGGGGSGGGGSGGGGSQVQLQESGPGLVKPSETLSLTCTV SGVSLPDYGVSWIRQPPGKGLEWIGVIWGSETTYYQSSLKS RVTISKDNSKNQVSLKLSSVTAADTAVYYCAKHYYYGGSY AMDYWGQGTLVTVSSTTTPAPRPPTPAPTIASQPLSLRPEAC RPAAGGAVHTRGLDFACDIYIWAPLAGTCGVLLLSLVITLY CKRGRKKLLYIFKQPFMRPVQTTQEEDGCSCRFPEEEEGGC ELRVKFSRSADAPAYQQGQNQLYNELNLGRREEYDVLDKR RGRDPEMGGKPRRKNPQEGLYNELQKDKMAEAYSEIGMK GERRRGKGHDGLYQGLSTATKDTYDALHMQALPPRGGGG SGGGGTGGGGSGMHKRSHTGERPFQCNQCGASFTQKGNLL RHIKLHTGEKPFKCHLCNTASAEARHIKAEMG |
| SEQ ID NO: 31 | CAR19_16GS_HilD tag_NoK (construct 770)(aa) | MALPVTALLLPLALLLHAARPEIVMTQSPATLSLSPGERATL SCRASQDISKYLNWYQQKPGQAPRLLIYHTSRLHSGIPARFS GSGSGTDYTLTISSLQPEDFAVYFCQQGNTLPYTFGQGTKLE IKGGGGSGGGGSGGGGSQVQLQESGPGLVKPSETLSLTCTV SGVSLPDYGVSWIRQPPGKGLEWIGVIWGSETTYYQSSLKS RVTISKDNSKNQVSLKLSSVTAADTAVYYCAKHYYYGGSY AMDYWGQGTLVTVSSTTTPAPRPPTPAPTIASQPLSLRPEAC RPAAGGAVHTRGLDFACDIYIWAPLAGTCGVLLLSLVITLY CKRGRKKLLYIFKQPFMRPVQTTQEEDGCSCRFPEEEEGGC ELRVKFSRSADAPAYQQGQNQLYNELNLGRREEYDVLDKR RGRDPEMGGKPRRKNPQEGLYNELQKDKMAEAYSEIGMK GERRRGKGHDGLYQGLSTATKDTYDALHMQALPPRGGGG SGGGGTGGGGSGMHRRSHTGERPFQCNQCGASFTQRGNLL RHIRLHTGERPFRCHLCNTASAEARHIRAEMG |
| SEQ ID NO: 95 | CAR19_HilD tag_V5 (construct 771)(aa) | MALPVTALLLPLALLLHAARPEIVMTQSPATLSLSPGERATL SCRASQDISKYLNWYQQKPGQAPRLLIYHTSRLHSGIPARFS GSGSGTDYTLTISSLQPEDFAVYFCQQGNTLPYTFGQGTKLE IKGGGGSGGGGSGGGGSQVQLQESGPGLVKPSETLSLTCTV SGVSLPDYGVSWIRQPPGKGLEWIGVIWGSETTYYQSSLKS RVTISKDNSKNQVSLKLSSVTAADTAVYYCAKHYYYGGSY AMDYWGQGTLVTVSSTTTPAPRPPTPAPTIASQPLSLRPEAC RPAAGGAVHTRGLDFACDIYIWAPLAGTCGVLLLSLVITLY CKRGRKKLLYIFKQPFMRPVQTTQEEDGCSCRFPEEEEGGC ELRVKFSRSADAPAYQQGQNQLYNELNLGRREEYDVLDKR RGRDPEMGGKPRRKNPQEGLYNELQKDKMAEAYSEIGMK GERRRGKGHDGLYQGLSTATKDTYDALHMQALPPRMHKR SHTGERPFQCNQCGASFTQKGNLLRHIKLHTGEKPFKCHLC NTASAEARHIKAEMGGKPIPNPLLGLDST |
| SEQ ID NO: 96 | CAR19_16KGS_Hil D tag_V5 (construct 6761)(aa) | MALPVTALLLPLALLLHAARPEIVMTQSPATLSLSPGERATL SCRASQDISKYLNWYQQKPGQAPRLLIYHTSRLHSGIPARFS GSGSGTDYTLTISSLQPEDFAVYFCQQGNTLPYTFGQGTKLE IKGGGGSGGGGSGGGGSQVQLQESGPGLVKPSETLSLTCTV SGVSLPDYGVSWIRQPPGKGLEWIGVIWGSETTYYQSSLKS RVTISKDNSKNQVSLKLSSVTAADTAVYYCAKHYYYGGSY AMDYWGQGTLVTVSSTTTPAPRPPTPAPTIASQPLSLRPEAC RPAAGGAVHTRGLDFACDIYIWAPLAGTCGVLLLSLVITLY CKRGRKKLLYIFKQPFMRPVQTTQEEDGCSCRFPEEEEGGC ELRVKFSRSADAPAYQQGQNQLYNELNLGRREEYDVLDKR RGRDPEMGGKPRRKNPQEGLYNELQKDKMAEAYSEIGMK |

TABLE 4-continued

CAR modified with degadation tag and/or FurON

| SEQ ID NO | Description | Amino acid sequences (signal peptide included) |
|---|---|---|
| | | GERRRGKGHDGLYQGLSTATKDTYDALHMQALPPRKGGG SKGGGTKGGGSKMHKRSHTGERPFQCNQCGASFTQKGNLL RHIKLHTGEKPFKCHLCNTASAEARHIKAEMGGKPIPNPLLG LDST |
| SEQ ID NO: 97 | HilD tag_CAR19_modSig Pep (construct 773) (aa) | MALPVTALLLPLALLLHAARPRSSLAHKRSHTGERPFQCNQ CGASFTQKGNLLRHIKLHTGEKPFKCHLCNTASAEARHIKA EMGGTGAEDPRPSRKRRSLGDVGEIVMTQSPATLSLSPGER ATLSCRASQDISKYLNWYQQKPGQAPRLLIYHTSRLHSGIPA RFSGSGSGTDYTLTISSLQPEDFAVYFCQQGNTLPYTFGQGT KLEIKGGGGSGGGGSGGGGSQVQLQESGPGLVKPSETLSLT CTVSGVSLPDYGVSWIRQPPGKGLEWIGVIWGSETTYYQSS LKSRVTISKDNSKNQVSLKLSSVTAADTAVYYCAKHYYYG GSYAMDYWGQGTLVTVSSTTTPAPRPPTPAPTIASQPLSLRP EACRPAAGGAVHTRGLDFACDIYIWAPLAGTCGVLLLSLVI TLYCKRGRKKLLYIFKQPFMRPVQTTQEEDGCSCRFPEEEEG GCELRVKFSRSADAPAYQQGQNQLYNELNLGRREEYDVLD KRRGRDPEMGGKPRRKNPQEGLYNELQKDKMAEAYSEIG MKGERRRGKGHDGLYQGLSTATKDTYDALHMQALPPR |
| SEQ ID NO: 98 | HilD tag_CAR19 (construct 774)(aa) | MALPVTALLLPLALLLHAARPHKRSHTGERPFQCNQCGASF TQKGNLLRHIKLHTGEKPFKCHLCNTASAEARHIKAEMGGT GAEDPRPSRKRRSLGDVGEIVMTQSPATLSLSPGERATLSCR ASQDISKYLNWYQQKPGQAPRLLIYHTSRLHSGIPARFSGSG SGTDYTLTISSLQPEDFAVYFCQQGNTLPYTFGQGTKLEIKG GGGSGGGGSGGGGSQVQLQESGPGLVKPSETLSLTCTVSGV SLPDYGVSWIRQPPGKGLEWIGVIWGSETTYYQSSLKSRVTI SKDNSKNQVSLKLSSVTAADTAVYYCAKHYYYGGSYAMD YWGQGTLVTVSSTTTPAPRPPTPAPTIASQPLSLRPEACRPA AGGAVHTRGLDFACDIYIWAPLAGTCGVLLLSLVITLYCKR GRKKLLYIFKQPFMRPVQTTQEEDGCSCRFPEEEEGGCELRV KFSRSADAPAYQQGQNQLYNELNLGRREEYDVLDKRRGRD PEMGGKPRRKNPQEGLYNELQKDKMAEAYSEIGMKGERRR GKGHDGLYQGLSTATKDTYDALHMQALPPR |
| SEQ ID NO: 112 | CAR19-16GS-CARBtag (aa) | MALPVTALLLPLALLLHAARPEIVMTQSPATLSLSPGERATL SCRASQDISKYLNWYQQKPGQAPRLLIYHTSRLHSGIPARFS GSGSGTDYTLTISSLQPEDFAVYFCQQGNTLPYTFGQGTKLE IKGGGGSGGGGSGGGGSQVQLQESGPGLVKPSETLSLTCTV SGVSLPDYGVSWIRQPPGKGLEWIGVIWGSETTYYQSSLKS RVTISKDNSKNQVSLKLSSVTAADTAVYYCAKHYYYGGSY AMDYWGQGTLVTVSSTTTPAPRPPTPAPTIASQPLSLRPEAC RPAAGGAVHTRGLDFACDIYIWAPLAGTCGVLLLSLVITLY CKRGRKKLLYIFKQPFMRPVQTTQEEDGCSCRFPEEEEGGC ELRVKFSRSADAPAYQQGQNQLYNELNLGRREEYDVLDKR RGRDPEMGGKPRRKNPQEGLYNELQKDKMAEAYSEIGMK GERRRGKGHDGLYQGLSTATKDTYDALHMQALPPRGGGG SGGGGTGGGGSGHKRSHTGERPFHCNQCGASFTQKGNLLR HIKLHSGEKPFKCPFCSAGQVMSHHVPPMED |
| SEQ ID NO: 1450 | BCMA CAR-16G5 linker-HilD (aa) | MALPVTALLLPLALLLHAARPEVQLVESGGGLVQPGGSLRL SCAVSGFALSNHGMSWVRRAPGKGLEWVSGIVYSGSTYYA ASVKGRFTISRDNSRNTLYLQMNSLRPEDTAIYYCSAHGGES DVWGQGTTVTVSSASGGGGSGGRASGGGGSDIQLTQSPSSL SASVGDRVTITCRASQSISSYLNWYQQKPGKAPKLLIYAASS LQSGVPSRFSGSGSGTDFTLTISSLQPEDFATYYCQQSYSTPY TFGQGTKVEIKTTTPAPRPPTPAPTIASQPLSLRPEACRPAAG GAVHTRGLDFACDIYIWAPLAGTCGVLLLSLVITLYCKRGR KKLLYIFKQPFMRPVQTTQEEDGCSCRFPEEEEGGCELRVKF SRSADAPAYQQGQNQLYNELNLGRREEYDVLDKRRGRDPE MGGKPRRKNPQEGLYNELQKDKMAEAYSEIGMKGERRRG KGHDGLYQGLSTATKDTYDALHMQALPPRGGGGSGGGGT GGGGSGMHKRSHTGERPFQCNQCGASFTQKGNLLRHIKLH TGEKPFKCHLCNTASAEARHIKAEMG |
| SEQ ID NO: 837 | | MALEK |

In one aspect, an exemplary CAR constructs comprise an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), and an intracellular stimulatory domain (e.g., an intracellular stimulatory domain described herein). In one aspect, an exemplary CAR construct comprises an optional leader sequence (e.g., a leader sequence described herein), an extracellular antigen binding domain (e.g., an antigen binding domain described herein), a hinge (e.g., a hinge region described herein), a transmembrane domain (e.g., a transmembrane domain described herein), an intracellular costimulatory signaling domain (e.g., a costimulatory signaling domain described herein) and/or an intracellular primary signaling domain (e.g., a primary signaling domain described herein).

In one aspect, the CARs (e.g., CD19 CARs) of the invention comprise at least one intracellular signaling domain selected from the group of a CD137 (4-1BB) signaling domain, a CD28 signaling domain, a CD27 signaling domain, an ICOS signaling domain, a CD3zeta signal domain, and any combination thereof. In one aspect, the CARs comprise at least one intracellular signaling domain is from one or more costimulatory molecule(s) selected from CD137 (4-1BB), CD28, CD27, or ICOS.

CAR Antigen Binding Domain

In one aspect, the CAR of the disclosure linked to a COF1/CRBN-, COF2/CRBN-, or COF3/CRBN-binding polypeptide, and/or a degradation domain comprises a target-specific binding element otherwise referred to as an antigen binding domain. In one embodiment, the portion of the CAR comprising the antigen binding domain comprises an antigen binding domain that targets, e.g., specifically binds to, an antigen, e.g., antigen described herein, e.g., CD19. In one embodiment, the antigen binding domain targets, e.g., specifically binds to, human CD19.

In some embodiments, a plurality of immune effector cells, e.g., the population of T regulatory-depleted cells, include a nucleic acid encoding a CAR that comprises a target-specific binding element otherwise referred to as an antigen binding domain. The choice of binding element depends upon the type and number of ligands that define the surface of a target cell. For example, the antigen binding domain may be chosen to recognize a ligand that acts as a cell surface marker on target cells associated with a particular disease state. Thus, examples of cell surface markers that may act as ligands for the antigen binding domain in a CAR described herein include those associated with viral, bacterial and parasitic infections, autoimmune disease and cancer cells.

In one aspect, the portion of the CAR comprising the antigen binding domain comprises an antigen binding domain that targets a tumor antigen, e.g., a tumor antigen described herein. In some embodiments, the antigen binding domain is chosen from: CD19; CD123; CD22; CD30; CD171; CS-1; C-type lectin-like molecule-1, CD33; epidermal growth factor receptor variant III (EGFRvIII); ganglioside G2 (GD2); ganglioside GD3; TNF receptor family member; B-cell maturation antigen (BCMA); Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2; Mesothelin; Interleukin 11 receptor alpha (IL-11Ra); prostate stem cell antigen (PSCA); Protease Serine 21; vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3; transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1, melanoma antigen recognized by T cells 1; Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like, Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

In one embodiment, the antigen binding domain binds to CD19. In another embodiment, the antigen binding domain binds to CD123. In another embodiment, the antigen binding domain binds to BCMA. In another embodiment, the antigen binding domain binds to CD20.

The antigen binding domain can be any domain that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, a T cell receptor (TCR), or a fragment there of, e.g., single chain TCR, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

The antigen binding domain can be any domain that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as an antigen binding domain, such as a recombinant fibronectin domain, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment. Thus, in one aspect, the antigen binding domain comprises a human antibody or an antibody fragment.

In one embodiment, the antigen binding domain comprises one, two, or three (e.g., all three) heavy chain CDRs, HC CDR1, HC CDR2 and HC CDR3, from an antibody described herein (e.g., an antibody described in WO2015/142675, US-2015-0283178-A1, US-2016-0046724-A1, US2014/0322212A1, US2016/0068601A1, US2016/0051651A1, US2016/0096892A1, US2014/0322275A1, or WO2015/090230, incorporated herein by reference), and/or one, two, or three (e.g., all three) light chain CDRs, LC CDR1, LC CDR2 and LC CDR3, from an antibody described herein (e.g., an antibody described in WO2015/142675, US-2015-0283178-A1, US-2016-0046724-A1, US2014/0322212A1, US2016/0068601A1, US2016/0051651A1, US2016/0096892A1, US2014/0322275A1, or WO2015/090230, incorporated herein by reference). In one embodiment, the antigen binding domain comprises a heavy chain variable region and/or a variable light chain region of an antibody listed above.

In embodiments, the antigen binding domain is an antigen binding domain described in WO2015/142675, US-2015-0283178-A1, US-2016-0046724-A1, US2014/0322212A1, US2016/0068601A1, US2016/0051651A1, US2016/0096892A1, US2014/0322275A1, or WO2015/090230, incorporated herein by reference.

Exemplary target antigens that can be targeted using the CAR-expressing cells, include, but are not limited to, CD19, CD123, EGFRvIII, CD33, mesothelin, BCMA, and GFR ALPHA-4, among others, as described in, for example, WO2014/153270, WO 2014/130635, WO2016/028896, WO 2014/130657, WO2016/014576, WO 2015/090230, WO2016/014565, WO2016/014535, and WO2016/025880, each of which is herein incorporated by reference in its entirety.

Multispecific CAR

In some embodiments, the CAR molecule is a multispecific, e.g., bispecific, CAR molecule having a first binding specificity for a first antigen, e.g., a B-cell epitope, and a second binding specificity for the same or a different antigen, e.g., a B cell epitope. In some embodiments, the bispecific CAR molecule has a first binding specificity for CD19 (e.g., the bispecific CAR molecule comprises an anti-CD19 CAR disclosed in Tables 5, 6, 7 and 30) and a second binding specificity for CD22 (e.g., the bispecific CAR molecule comprises an anti-CD22 CAR disclosed in Tables 19 and 20). In some embodiments, the bispecific CAR molecule has a first binding specificity for CD19 (e.g., the bispecific CAR molecule comprises an anti-CD19 CAR disclosed in Tables 5, 6, 7 and 30) and a second binding specificity for CD20 (e.g., the bispecific CAR molecule comprises an anti-CD20 CAR disclosed in Table 32).

In one embodiment, the first and second binding specificity is an antibody molecule, e.g., an antibody binding domain (e.g., a scFv). Within each antibody molecule (e.g., scFv) of a bispecific CAR molecule, the VH can be upstream or downstream of the VL.

In some embodiments, the upstream antibody or antibody fragment (e.g., scFv) is arranged with its VH ($VH_1$) upstream of its VL ($VL_1$) and the downstream antibody or antibody fragment (e.g., scFv) is arranged with its VL ($VL_2$) upstream of its VH ($VH_2$), such that the overall bispecific CAR molecule has the arrangement $VH_1$-$VL_1$-$VL_2$-$VH_2$, from an N- to C-terminal orientation.

In some embodiments, the upstream antibody or antibody fragment (e.g., scFv) is arranged with its VL ($VL_1$) upstream of its VH ($VH_1$) and the downstream antibody or antibody fragment (e.g., scFv) is arranged with its VH ($VH_2$) upstream of its VL ($VL_2$), such that the overall bispecific CAR molecule has the arrangement $VL_1$-$VH_1$—$VH_2$—$VL_2$, from an N- to C-terminal orientation.

In some embodiments, the upstream antibody or antibody fragment (e.g., scFv) is arranged with its VL ($VL_1$) upstream of its VH ($VH_1$) and the downstream antibody or antibody fragment (e.g., scFv) is arranged with its VL ($VL_2$) upstream of its VH ($VH_2$), such that the overall bispecific CAR molecule has the arrangement $VL_1$-$VH_1$—$VL_2$-$VH_2$, from an N- to C-terminal orientation.

In yet some embodiments, the upstream antibody or antibody fragment (e.g., scFv) is arranged with its VH ($VH_1$) upstream of its VL ($VL_1$) and the downstream antibody or antibody fragment (e.g., scFv) is arranged with its VH ($VH_2$) upstream of its VL ($VL_2$), such that the overall bispecific CAR molecule has the arrangement VH$_1$—VL$_1$-VH$_2$—VL$_2$, from an N- to C-terminal orientation.

In any of the aforesaid configurations, optionally, a linker is disposed between the two antibodies or antibody fragments (e.g., scFvs), e.g., between VL$_1$ and VL$_2$ if the construct is arranged as VH$_1$-VL$_1$-VL$_2$-VH$_2$; between VH$_1$ and VH$_2$ if the construct is arranged as VL$_1$-VH$_1$-VH$_2$-VL$_2$; between VH$_1$ and VL$_2$ if the construct is arranged as VL$_1$-VH$_1$-VL$_2$-VH$_2$; or between VL$_1$ and VH$_2$ if the construct is arranged as VH$_1$-VL$_1$-VH$_2$-VL$_2$. In general, the linker between the two scFvs should be long enough to avoid mispairing between the domains of the two scFvs. The linker may be a linker as described herein. In some embodiments, the linker is a (Gly$_4$-Ser)$_n$ linker, wherein n is 1, 2, 3, 4, 5, or 6. In some embodiments, the linker is (Gly$_4$-Ser)$_n$, wherein n=1 (SEQ ID NO: 168), e.g., the linker has the amino acid sequence Gly$_4$-Ser (SEQ ID NO: 168). In some embodiments, the linker is (Gly$_4$-Ser)$_n$, wherein n=3 (SEQ ID NO: 142). In some embodiments, the linker is (Gly$_4$-Ser)$_n$, wherein n=4 (SEQ ID NO: 141). In some embodiments, the linker comprises, e.g., consists of, the amino acid sequence: LAEAAAK (SEQ ID NO: 822).

In any of the aforesaid configurations, optionally, a linker is disposed between the VL and VH of the first scFv. Optionally, a linker is disposed between the VL and VH of the second scFv. In constructs that have multiple linkers, any two or more of the linkers can be the same or different. Accordingly, in some embodiments, a bispecific CAR comprises VLs, VHs, and optionally one or more linkers in an arrangement as described herein.

In some embodiments, each antibody molecule, e.g., each antigen binding domain (e.g., each scFv) comprises a linker between the VH and the VL regions. In some embodiments, the linker between the VH and the VL regions is a (Gly$_4$-Ser)$_n$ linker, wherein n is 1, 2, 3, 4, 5, or 6. In some embodiments, the linker is (Gly$_4$-Ser)$_n$, wherein n=1 (SEQ ID NO: 168), e.g., the linker has the amino acid sequence Gly$_4$-Ser (SEQ ID NO: 168). In some embodiments, the linker is (Gly$_4$-Ser)$_n$, wherein n=3 (SEQ ID NO: 142). In some embodiments, the linker is (Gly$_4$-Ser)$_n$, wherein n=4 (SEQ ID NO: 141). In some embodiments, the VH and VL regions are connected without a linker.

Additional exemplary multispecific CAR molecules are disclosed on pages 26-39 of WO2018/067992, herein incorporated by reference.

CD19 CAR

In other embodiments, the CAR-expressing cells can specifically bind to CD19, e.g., can include a CAR molecule, or an antigen binding domain (e.g., a humanized antigen binding domain) according to Table 3 of WO2014/153270, incorporated herein by reference.

In embodiments, the CAR molecule comprises an antigen binding domain that binds specifically to CD19 (CD19 CAR). In one embodiment, the antigen binding domain targets human CD19. In one embodiment, the antigen binding domain of the CAR has the same or a similar binding specificity as the FMC63 scFv fragment described in Nicholson et al. Mol. Immun 34 (16-17): 1157-1165 (1997). In one embodiment, the antigen binding domain of the CAR includes the scFv fragment described in Nicholson et al. Mol. Immun. 34 (16-17): 1157-1165 (1997). A CD19 antibody molecule can be, e.g., an antibody molecule (e.g., a humanized anti-CD19 antibody molecule) described in WO2014/153270, which is incorporated herein by reference in its entirety. WO2014/153270 also describes methods of assaying the binding and efficacy of various CAR constructs.

In one aspect, the parental murine scFv sequence is the CAR19 construct provided in PCT publication WO2012/079000 (incorporated herein by reference). In one embodiment, the anti-CD19 binding domain is a scFv described in WO2012/079000.

In one embodiment, the CAR molecule comprises the fusion polypeptide sequence provided as SEQ ID NO: 12 in PCT publication WO2012/079000, and provided herein in Table 5, which provides an scFv fragment of murine origin that specifically binds to human CD19. Humanization of this mouse scFv may be desired for the clinical setting, where the mouse-specific residues may induce a human-anti-mouse antigen (HAMA) response in patients who receive CART19 treatment, e.g., treatment with T cells transduced with the CAR19 construct.

In one embodiment, the CD19 CAR comprises an amino acid sequence provided as SEQ ID NO: 12 in PCT publication WO2012/079000. In embodiment, the amino acid sequence is (SEQ ID NO: 181)
(MALPVTALLLPLALLLHAARP)diqmtqttsslsaslgdrvtiscra sqdiskylnwyqqkpdgtvklliyhtsrlhsgvpsrfsgsgsgtdysl tisnleqediatyfcqqgntlpytfgggtkleitggggsggggsgggg sevklqesgpglvapsqslsvtctvsgvslpdygvswirqpprkglew lgviwgsettyynsalksrltiikdnsksqvflkmnslqtddtaiyyc akhyyyggsyamdywgqgtsvtvsstttpaprpptpaptiasqplslr peacrpaaggavhtrgldfacdiyiwaplagtcgvlllslvitlyckr grkkllyifkqpfmrpvqttqeedgcscrfpeeeeggcelrvkfsrsa dapaykqgqnqlynelnlgrreeydvldkrrgrdpemggkprrknpqe glynelqkdkmaeayseigmkgerrrgkghdglyqglstatkdtydal hmqalppr, or a sequence substantially homologous thereto. The optional sequence of the signal peptide is shown in capital letters and parenthesis.

In one embodiment, the amino acid sequence is:

(SEQ ID NO: 182)
Diqmtqttsslsaslgdrvtiscrasqdiskylnwyqqkpdgtvklliyh tsrlhsgvpsrfsgsgsgtdysltisnleqediatyfcqqgntlpytfgg gtkleitggggsggggsggggsevklqesgpglvapsqslsvtctvsgvs lpdygvswirqpprkglewlgviwgsettyynsalksrltiikdnsksqv flkmnslqtddtaiyycakhyyyggsyamdywgqgtsvtvsstttpaprp ptpaptiasqplslrpeacrpaaggavhtrgldfacdiyiwaplagtcgv lllslvitlyckrgrkkllyifkqpfmrpvqttqeedgcscrfpeeeegg celrvkfsrsadapaykqgqnqlynelnlgrreeydvldkrrgrdpemgg kprrknpqeglynelqkdkmaeayseigmkgeragkghdglyqglstatk dtydalhmqalppr, or a sequence substantially homologous thereto.

In one embodiment, the CD19 CAR has the USAN designation TISAGENLECLEUCEL-T. In embodiments, CTL019 is made by a gene modification of T cells is mediated by stable insertion via transduction with a self-inactivating, replication deficient Lentiviral (LV) vector containing the CTL019 transgene under the control of the EF-1 alpha promoter. CTL019 can be a mixture of transgene positive and negative T cells that are delivered to the subject on the basis of percent transgene positive T cells.

In other embodiments, the CD19 CAR comprises an antigen binding domain (e.g., a humanized antigen binding domain) according to Table 3 of WO2014/153270, incorporated herein by reference.

Humanization of murine CD19 antibody is desired for the clinical setting, where the mouse-specific residues may induce a human-anti-mouse antigen (HAMA) response in patients who receive CART19 treatment, i.e., treatment with T cells transduced with the CAR19 construct. The production, characterization, and efficacy of humanized CD19 CAR sequences is described in International Application WO2014/153270 which is herein incorporated by reference in its entirety, including Examples 1-5 (p. 115-159).

In some embodiments, CD19 CAR constructs are described in PCT publication WO 2012/079000, incorporated herein by reference, and the amino acid sequence of the murine CD19 CAR and scFv constructs are shown in Table 5 below, or a sequence substantially identical to any of the aforesaid sequences (e.g., at least 85%, 90%, 95% or more identical to any of the sequences described herein).

TABLE 5

| SEQ ID NO | Region | Sequence |
|---|---|---|
| \multicolumn{3}{c}{CTL019} | | |
| SEQ ID NO: 183 | CTL019 Full amino acid sequence | MALPVTALLLPLALLLHAARPDIQMTQTTSSLSASLGDRV TISCRASQDISKYLNWYQQKPDGTVKLLIYHTSRLHSGVPS RFSGSGSGTDYSLTISNLEQEDIATYFCQQGNTLPYTFGGG TKLEITGGGGSGGGGSGGGGSEVKLQESGPGLVAPSQSLS VTCTVSGVSLPDYGVSWIRQPPRKGLEWLGVIWGSETTYY NSALKSRLTIIKDNSKSQVFLKMNSLQTDDTAIYYCAKHY YYGGSYAMDYWGQGTSVTVSSTTTPAPRPPTPAPTIASQP LSLRPEACRPAAGGAVHTRGLDFACDIYIWAPLAGTCGVL LLSLVITLYCKRGRKKLLYIFKQPFMRPVQTTQEEDGCSCR FPEEEEGGCELRVKFSRSADAPAYKQGQNQLYNELNLGRR EEYDVLDKRRGRDPEMGGKPRRKNPQEGLYNELQKDKM AEAYSEIGMKGERRRGKGHDGLYQGLSTATKDTYDALH MQALPPR |
| SEQ ID NO: 184 | CTL019 Full nucleotide sequence | ATGGCCTTACCAGTGACCGCCTTGCTCCTGCCGCTGGCC TTGCTGCTCCACGCCGCCAGGCCGGACATCCAGATGAC ACAGACTACATCCTCCCTGTCTGCCTCTCTGGGAGACAG AGTCACCATCAGTTGCAGGGCAAGTCAGGACATTAGTA AATATTTAAATTGGTATCAGCAGAAACCAGATGGAACT GTTAAACTCCTGATCTACCATACATCAAGATTACACTCA GGAGTCCCATCAAGGTTCAGTGGCAGTGGGTCTGGAAC AGATTATTCTCTCACCATTAGCAACCTGGAGCAAGAAG ATATTGCCACTTACTTTTGCCAACAGGGTAATACGCTTC CGTACACGTTCGGAGGGGGGACCAAGCTGGAGATCACA GGTGGCGGTGGCTCGGGCGGTGGTGGGTCGGGTGGCGG CGGATCTGAGGTGAAACTGCAGGAGTCAGGACCTGGCC TGGTGGCGCCCTCACAGAGCCTGTCCGTCACATGCACTG TCTCAGGGGTCTCATTACCCGACTATGGTGTAAGCTGGA TTCGCCAGCCTCCACGAAAGGGTCTGGAGTGGCTGGGA GTAATATGGGGTAGTGAAACCACATACTATAATTCAGC TCTCAAATCCAGACTGACCATCATCAAGGACAACTCCA AGAGCCAAGTTTTCTTAAAAATGAACAGTCTGCAAACT GATGACACAGCCATTTACTACTGTGCCAAACATTATTAC TACGGTGGTAGCTATGCTATGGACTACTGGGGCCAAGG AACCTCAGTCACCGTCTCCTCAACCACGACGCCAGCGCC GCGACCACCAACACCGGCGCCCACCATCGCGTCGCAGC CCCTGTCCCTGCGCCCAGAGGCGTGCCGGCCAGCGGCG GGGGGCGCAGTGCACACGAGGGGGCTGGACTTCGCCTG TGATATCTACATCTGGGCGCCCTTGGCCGGGACTTGTGG GGTCCTTCTCCTGTCACTGGTTATCACCCTTTACTGCAA ACGGGGCAGAAAGAAACTCCTGTATATATTCAAACAAC CATTTATGAGACCAGTACAAACTACTCAAGAGGAAGAT GGCTGTAGCTGCCGATTTCCAGAAGAAGAAGAAGGAGG ATGTGAACTGAGAGTGAAGTTCAGCAGGAGCGCAGACG CCCCCGCGTACAAGCAGGGCCAGAACCAGCTCTATAAC GAGCTCAATCTAGGACGAAGAGAGGAGTACGATGTTTT GGACAAGAGACGTGGCCGGGACCCTGAGATGGGGGGA AAGCCGAGAAGGAAGAACCCTCAGGAAGGCCTGTACA ATGAACTGCAGAAAGATAAGATGGCGGAGGCCTACAGT GAGATTGGGATGAAAGGCGAGCGCCGGAGGGGCAAGG GCACGATGGCCTTTACCAGGGTCTCAGTACAGCCACC AAGGACACCTACGACGCCCTTCACATGCAGGCCCTGCC CCCTCGC |

TABLE 5-continued

CD19 CAR Constructs

| SEQ ID NO | Region | Sequence |
| --- | --- | --- |
| SEQ ID NO: 185 | CTL019 scFv domain | DIQMTQTTSSLSASLGDRVTISCRASQDISKYLNWYQQKPD GTVKLLIYHTSRLHSGVPSRFSGSGSGTDYSLTISNLEQEDI ATYFCQQGNTLPYTFGGGTKLEITGGGGSGGGGSGGGGSE VKLQESGPGLVAPSQSLSVTCTVSGVSLPDYGVSWIRQPPR KGLEWLGVIWGSETTYYNSALKSRLTIIKDNSKSQVFLKM NSLQTDDTAIYYCAKHYYYGGSYAMDYWGQGTSVTVSS |

Humanized CAR2

| SEQ ID NO | Region | Sequence |
| --- | --- | --- |
| SEQ ID NO: 197 | CAR2 scFv domain - aa (Linker is underlined) | EIVMTQSPATLSLSPGERATLSCRASQDISKYLNWYQQKPG QAPRLLIYHTSRLHSGIPARFSGSGSGTDYTLTISSLQPEDF AVYFCQQGNTLPYTFGQGTKLEIKGGGGSGGGGSGGGGS QVQLQESGPGLVKPSETLSLTCTVSGVSLPDYGVSWIRQPP GKGLEWIGVIWGSETTYYQSSLKSRVTISKDNSKNQVSLK LSSVTAADTAVYYCAKHYYYGGSYAMDYWGQGTLVTVS S |
| SEQ ID NO: 198 | CAR2 scFv domain - nt | ATGGCCCTCCCTGTCACCGCCCTGCTGCTTCCGCTGGCT CTTCTGCTCCACGCCGCTCGGCCCGAAATTGTGATGACC CAGTCACCCGCCACTCTTAGCCTTTCACCCGGTGAGCGC GCAACCCTGTCTTGCAGAGCCTCCCAAGACATCTCAAA ATACCTTAATTGGTATCAACAGAAGCCCGGACAGGCTC CTCGCCTTCTGATCTACCACACCAGCCGGCTCCATTCTG GAATCCCTGCCAGGTTCAGCGGTAGCGGATCTGGGACC GACTACACCCTCACTATCAGCTCACTGCAGCCAGAGGA CTTCGCTGTCTATTTCTGTCAGCAAGGGAACACCCTGCC CTACACCTTTGGACAGGGCACCAAGCTCGAGATTAAAG GTGGAGGTGGCAGCGGAGGAGGTGGGTCCGGCGGTGG AGGAAGCCAGGTCCAACTCCAAGAAAGCGGACCGGGTC TTGTGAAGCCATCAGAAACTCTTTCACTGACTTGTACTG TGAGCGGAGTGTCTCTCCCCGATTACGGGGTGTCTTGGA TCAGACAGCCACCGGGGAAGGGTCTGGAATGGATTGGA GTGATTTGGGGCTCTGAGACTACTTACTACCAATCATCC CTCAAGTCACGCGTCACCATCTCAAAGGACAACTCTAA GAATCAGGTGTCACTGAAACTGTCATCTGTGACCGCAG CCGACACCGCCGTGTACTATTGCGCTAAGCATTACTATT ATGGCGGGAGCTACGCAATGGATTACTGGGGACAGGGT ACTCTGGTCACCGTGTCCAGCCACCACCATCATCACCAT CACCAT |
| SEQ ID NO: 199 | CAR 2 - Full - aa | MALPVTALLLPLALLLHAARPEIVMTQSPATLSLSPGERAT LSCRASQDISKYLNWYQQKPGQAPRLLIYHTSRLHSGIPAR FSGSGSGTDYTLTISSLQPEDFAVYFCQQGNTLPYTFGQGT KLEIKGGGGSGGGGSGGGGSQVQLQESGPGLVKPSETLSL TCTVSGVSLPDYGVSWIRQPPGKGLEWIGVIWGSETTYYQ SSLKSRVTISKDNSKNQVSLKLSSVTAADTAVYYCAKHYY YGGSYAMDYWGQGTLVTVSSTTTPAPRPPTPAPTIASQPLS LRPEACRPAAGGAVHTRGLDFACDIYIWAPLAGTCGVLLL SLVITLYCKRGRKKLLYIFKQPFMRPVQTTQEEDGCSRFP EEEEGGCELRVKFSRSADAPAYKQGQNQLYNELNLGRRE EYDVLDKRRGRDPEMGGKPRRKNPQEGLYNELQKDKMA EAYSEIGMKGERRRGKGHDGLYQGLSTATKDTYDALHM QALPPR |
| SEQ ID NO: 200 | CAR 2 - Full - nt | ATGGCCCTCCCTGTCACCGCCCTGCTGCTTCCGCTGGCT CTTCTGCTCCACGCCGCTCGGCCCGAAATTGTGATGACC CAGTCACCCGCCACTCTTAGCCTTTCACCCGGTGAGCGC GCAACCCTGTCTTGCAGAGCCTCCCAAGACATCTCAAA ATACCTTAATTGGTATCAACAGAAGCCCGGACAGGCTC CTCGCCTTCTGATCTACCACACCAGCCGGCTCCATTCTG GAATCCCTGCCAGGTTCAGCGGTAGCGGATCTGGGACC GACTACACCCTCACTATCAGCTCACTGCAGCCAGAGGA CTTCGCTGTCTATTTCTGTCAGCAAGGGAACACCCTGCC CTACACCTTTGGACAGGGCACCAAGCTCGAGATTAAAG GTGGAGGTGGCAGCGGAGGAGGTGGGTCCGGCGGTGG AGGAAGCCAGGTCCAACTCCAAGAAAGCGGACCGGGTC TTGTGAAGCCATCAGAAACTCTTTCACTGACTTGTACTG TGAGCGGAGTGTCTCTCCCCGATTACGGGGTGTCTTGGA TCAGACAGCCACCGGGGAAGGGTCTGGAATGGATTGGA GTGATTTGGGGCTCTGAGACTACTTACTACCAATCATCC CTCAAGTCACGCGTCACCATCTCAAAGGACAACTCTAA GAATCAGGTGTCACTGAAACTGTCATCTGTGACCGCAG CCGACACCGCCGTGTACTATTGCGCTAAGCATTACTATT ATGGCGGGAGCTACGCAATGGATTACTGGGGACAGGGT ACTCTGGTCACCGTGTCCAGCACCACTACCCCAGCACCG |

TABLE 5-continued

CD19 CAR Constructs

| SEQ ID NO | Region | Sequence |
|---|---|---|
| | | AGGCCACCCACCCCGGCTCCTACCATCGCCTCCCAGCCT<br>CTGTCCCTGCGTCCGGAGGCATGTAGACCCGCAGCTGGT<br>GGGGCCGTGCATACCCGGGGTCTTGACTTCGCCTGCGAT<br>ATCTACATTTGGGCCCCTCTGGCTGGTACTTGCGGGGTC<br>CTGCTGCTTTCACTCGTGATCACTCTTTACTGTAAGCGC<br>GGTCGGAAGAAGCTGCTGTACATCTTTAAGCAACCCTTC<br>ATGAGGCCTGTGCAGACTACTCAAGAGGAGGACGGCTG<br>TTCATGCCGGTTCCCAGAGGAGGAGGAAGGCGGCTGCG<br>AACTGCGCGTGAAATTCAGCCGCAGCGCAGATGCTCCA<br>GCCTACAAGCAGGGGCAGAACCAGCTCTACAACGAACT<br>CAATCTTGGTCGGAGAGAGGAGTACGACGTGCTGGACA<br>AGCGGAGAGGACGGGACCCAGAAATGGGCGGGAAGCC<br>GCGCAGAAAGAATCCCCAAGAGGGCCTGTACAACGAGC<br>TCCAAAAGGATAAGATGGCAGAAGCCTATAGCGAGATT<br>GGTATGAAAGGGGAACGCAGAAGAGGCAAAGGCCACG<br>ACGGACTGTACCAGGGACTCAGCACCGCCACCAAGGAC<br>ACCTATGACGCTCTTCACATGCAGGCCCTGCCGCCTCGG |
| SEQ ID NO: 201 | CAR2 - Soluble scFv - aa | MALPVTALLLPLALLLHAARPEIVMTQSPATLSLSPGERAT<br>LSCRASQDISKYLNWYQQKPGQAPRLLIYHTSRLHSGIPAR<br>FSGSGSGTDYTLTISSLQPEDFAVYFCQQGNTLPYTFGQGT<br>KLEIKGGGGSGGGGSGGGGSQVQLQESGPGLVKPSETLSL<br>TCTVSGVSLPDYGVSWIRQPPGKGLEWIGVIWGSETTYYQ<br>SSLKSRVTISKDNSKNQVSLKLSSVTAADTAVYYCAKHYY<br>YGGSYAMDYWGQGTLVTVSSHHHHHHHH |

Murine CART19

| | | |
|---|---|---|
| 221 | HCDR1 (Kabat) | DYGVS |
| 222 | HCDR2 (Kabat) | VIWGSETTYYNSALKS |
| 223 | HCDR3 (Kabat) | HYYYGGSYAMDY |
| 224 | LCDR1 (Kabat) | RASQDISKYLN |
| 225 | LCDR2 (Kabat) | HTSRLHS |
| 226 | LCDR3 (Kabat) | QQGNTLPYT |

Humanized CART19 a

| | | |
|---|---|---|
| 221 | HCDR1 (Kabat) | DYGVS |
| 227 | HCDR2 (Kabat) | VIWGSETTYYSSSLKS |
| 223 | HCDR3 (Kabat) | HYYYGGSYAMDY |
| 224 | LCDR1 (Kabat) | RASQDISKYLN |
| 225 | LCDR2 (Kabat) | HTSRLHS |
| 226 | LCDR3 (Kabat) | QQGNTLPYT |

Humanized CART19 b

| | | |
|---|---|---|
| 221 | HCDR1 (Kabat) | DYGVS |
| 228 | HCDR2 (Kabat) | VIWGSETTYYQSSLKS |
| 223 | HCDR3 (Kabat) | HYYYGGSYAMDY |

TABLE 5-continued

CD19 CAR Constructs

| SEQ ID NO | Region | Sequence |
|---|---|---|
| 224 | LCDR1 (Kabat) | RASQDISKYLN |
| 225 | LCDR2 (Kabat) | HTSRLHS |
| 226 | LCDR3 (Kabat) | QQGNTLPYT |
| | Humanized CART19 c | |
| 221 | HCDR1 (Kabat) | DYGVS |
| 229 | HCDR2 (Kabat) | VIWGSETTYYNSSLKS |
| 223 | HCDR3 (Kabat) | HYYYGGSYAMDY |
| 224 | LCDR1 (Kabat) | RASQDISKYLN |
| 225 | LCDR2 (Kabat) | HTSRLHS |
| 226 | LCDR3 (Kabat) | QQGNTLPYT |

TABLE 30

Additional CD19 CAR Constructs

| SEQ ID NO | Description |
|---|---|
| mCAR1 | |
| SEQ ID NO: 186 | mCAR1 scFv |
| SEQ ID NO: 187 | mCAR1 Full amino acid sequence |
| mCAR2 | |
| SEQ ID NO: 188 | mCAR2 scFv |
| SEQ ID NO: 189 | mCAR2 amino acid sequence |
| SEQ ID NO: 190 | mCAR2 full amino acid sequence |
| mCAR3 | |
| SEQ ID NO: 191 | mCAR3 scFv |
| SEQ ID NO: 192 | mCAR3 full amino acid sequence |
| SSJ25-C1 | |
| SEQ ID NO: 193 | SSJ25-C1 VH sequence |
| SEQ ID NO: 194 | SSJ25-C1 VL |
| Humanized CAR1 | |
| SEQ ID NO: 195 | CAR1 scFv domain |
| SEQ ID NO: 196 | CAR 1 - Full - aa |
| Humanized CAR3 | |
| SEQ ID NO: 202 | CAR3 scFv domain |
| SEQ ID NO: 203 | CAR 3 - Full - aa |
| Humanized CAR4 | |
| SEQ ID NO: 204 | CAR4 scFv domain |
| SEQ ID NO: 205 | CAR 4 - Full - aa |
| Humanized CAR5 | |
| SEQ ID NO: 206 | CAR5 scFv domain |
| SEQ ID NO: 207 | CAR 5 - Full - aa |
| Humanized CAR6 | |
| SEQ ID NO: 208 | CAR6 scFv domain |
| SEQ ID NO: 209 | CAR6 - Full - aa |
| Humanized CAR7 | |
| SEQ ID NO: 210 | CAR7 scFv domain |
| SEQ ID NO: 211 | CAR 7 Full - aa |
| Humanized CAR8 | |
| SEQ ID NO: 212 | CAR8 scFv domain |
| SEQ ID NO: 213 | CAR 8 - Full - aa |
| Humanized CAR9 | |
| SEQ ID NO: 214 | CAR9 scFv domain |
| SEQ ID NO: 215 | CAR 9 - Full - aa |
| Humanized CAR 10 | |
| SEQ ID NO: 216 | CAR10 scFv domain |
| SEQ ID NO: 215 | CAR 10 Full - aa |
| Humanized CAR11 | |
| SEQ ID NO: 217 | CAR11 scFv domain |
| SEQ ID NO: 218 | CAR 11 Full - aa |
| Humanized CAR 12 | |
| SEQ ID NO: 219 | CAR12 scFv domain |
| SEQ ID NO: 220 | CAR 12 - Full - aa |

CD19 CAR constructs containing humanized anti-CD19 scFv domains are described in PCT publication WO 2014/153270, incorporated herein by reference.

The sequences of murine and humanized CDR sequences of the anti-CD19 scFv domains are shown in Table 6 for the heavy chain variable domains and in Table 7 for the light chain variable domains. In some embodiments, the HCDR1 of a murine or humanized CD19 binding domain is GVSLPDYGVS (SEQ ID NO: 230).

TABLE 6

Heavy Chain Variable Domain CDR (Kabat) SEQ ID NOs of CD19 Antibodies

| Candidate | HCDR1 | HCDR2 | HCDR3 |
|---|---|---|---|
| murine_CART19 | SEQ ID NO: 221 | SEQ ID NO: 222 | SEQ ID NO: 223 |
| humanized_CART19 a | SEQ ID NO: 221 | SEQ ID NO: 227 | SEQ ID NO: 223 |
| humanized_CART19 b | SEQ ID NO: 221 | SEQ ID NO: 228 | SEQ ID NO: 223 |
| humanized_CART19 c | SEQ ID NO: 221 | SEQ ID NO: 229 | SEQ ID NO: 223 |

TABLE 7

Light Chain Variable Domain CDR (Kabat) SEQ ID NOs of CD19 Antibodies

| Candidate | LCDR1 | LCDR2 | LCDR3 |
|---|---|---|---|
| murine_CART 19 | SEQ ID NO: 224 | SEQ ID NO: 225 | SEQ ID NO: 226 |
| humanized_CART19 a | SEQ ID NO: 224 | SEQ ID NO: 225 | SEQ ID NO: 226 |
| humanized_CART19 b | SEQ ID NO: 224 | SEQ ID NO: 225 | SEQ ID NO: 226 |
| humanized_CART19 c | SEQ ID NO: 224 | SEQ ID NO: 225 | SEQ ID NO: 226 |

Any known CD19 CAR, e.g., the CD19 antigen binding domain of any known CD19 CAR, in the art can be used in accordance with the present disclosure. For example, LG-740; CD19 CAR described in the U.S. Pat. Nos. 8,399,645; 7,446,190; Xu et al., Leuk Lymphoma. 2013 54(2): 255-260 (2012); Cruz et al., Blood 122(17):2965-2973 (2013); Brentjens et al., Blood, 118(18):4817-4828 (2011); Kochenderfer et al., Blood 116(20):4099-102 (2010); Kochenderfer et al., Blood 122 (25):4129-39 (2013); and 16th Annu Meet Am Soc Gen Cell Ther (ASGCT) (May 15-18, Salt Lake City) 2013, Abst 10.

Exemplary CD19 CARs include CD19 CARs described herein, e.g., in one or more tables described herein, or an anti-CD19 CAR described in Xu et al. Blood 123.24 (2014): 3750-9; Kochenderfer et al. Blood 122.25 (2013):4129-39, Cruz et al. Blood 122.17 (2013):2965-73, NCT00586391, NCT01087294, NCT02456350, NCT00840853, NCT02659943, NCT02650999, NCT02640209, NCT01747486, NCT02546739, NCT02656147, NCT02772198, NCT00709033, NCT02081937, NCT00924326, NCT02735083, NCT02794246, NCT02746952, NCT01593696, NCT02134262, NCT01853631, NCT02443831, NCT02277522, NCT02348216, NCT02614066, NCT02030834, NCT02624258, NCT02625480, NCT02030847, NCT02644655, NCT02349698, NCT02813837, NCT02050347, NCT01683279, NCT02529813, NCT02537977, NCT02799550, NCT02672501, NCT02819583, NCT02028455, NCT01840566, NCT01318317, NCT01864889, NCT02706405, NCT01475058, NCT01430390, NCT02146924, NCT02051257, NCT02431988, NCT01815749, NCT02153580, NCT01865617, NCT02208362, NCT02685670, NCT02535364, NCT02631044, NCT02728882, NCT02735291, NCT01860937, NCT02822326, NCT02737085, NCT02465983, NCT02132624, NCT02782351, NCT01493453, NCT02652910, NCT02247609, NCT01029366, NCT01626495, NCT02721407, NCT01044069, NCT00422383, NCT01680991, NCT02794961, or NCT02456207, each of which is incorporated herein by reference in its entirety.

CD123 CAR

In other embodiments, the CAR-expressing cells can specifically bind to CD123, e.g., can include a CAR molecule (e.g., any of the CAR1 to $CAR_8$), or an antigen binding domain according to Tables 1-2 of WO 2014/130635, incorporated herein by reference. The amino acid and nucleotide sequences encoding the CD123 CAR molecules and antigen binding domains (e.g., including one, two, three VH CDRs; and one, two, three VL CDRs according to Kabat or Chothia), as specified in WO 2014/130635, are provided in Tables 8-14 Amino and nucleotide sequences identical and substantially identical to the aforesaid sequences provided in Tables 8-14 are specifically incorporated into the instant specification.

The CDRs for CD123 binding domains provided in Tables 8-14 are according to a combination of the Kabat and Chothia numbering scheme.

TABLE 8

Heavy Chain Variable Domain CDRs

| Candidate | HCDR1 | SEQ ID NO | HCDR2 | SEQ ID NO | HCDR3 | SEQ ID NO |
|---|---|---|---|---|---|---|
| CAR123-2 | GYTFTGYYMH | 231 | WINPNSGGTNYAQKFQG | 234 | DMNILATVPFDI | 236 |
| CAR123-3 | GYIFTGYYIH | 232 | WINPNSGGTNYAQKFQG | 234 | DMNILATVPFDI | 236 |
| CAR123-4 | GYTFTGYYMH | 231 | WINPNSGGTNYAQKFQG | 234 | DMNILATVPFDI | 236 |
| CAR123-1 | GYTFTDYYMH | 233 | WINPNSGDTNYAQKFQG | 235 | DMNILATVPFDI | 236 |

TABLE 9

Light Chain Variable Domain CDRs

| Candidate | LCDR1 | SEQ ID NO | LCDR2 | SEQ ID NO | LCDR3 | SEQ ID NO |
|---|---|---|---|---|---|---|
| CAR123-2 | RASQSISSYLN | 237 | AAFSLQS | 239 | QQGDSVPLT | 241 |
| CAR123-3 | RASQSISSYLN | 237 | AASSLQS | 240 | QQGDSVPLT | 241 |
| CAR123-4 | RASQSISSYLN | 237 | AASSLQS | 240 | QQGDSVPLT | 241 |
| CAR123-1 | RASQSISTYLN | 238 | AASSLQS | 240 | QQGDSVPLT | 241 |

TABLE 10

Heavy Chain Variable Domain CDR

| | HCDR1 | SEQ ID NO | HCDR2 | SEQ ID NO | HCDR3 | SEQ ID NO |
|---|---|---|---|---|---|---|
| hzCAR123 | GYTFTSYWMN | 242 | RIDPYDSETHYNQKFKD | 243 | GNWDDY | 244 |

TABLE 11

Light Chain Variable Domain CDR

| | LCDR1 | SEQ ID NO | LCDR2 | SEQ ID NO | LCDR3 | SEQ ID NO |
|---|---|---|---|---|---|---|
| hzCAR123 | RASKSISKDLA | 245 | SGSTLQS | 246 | QQHNKYPYT | 247 |

TABLE 12

Exemplary CD123 CAR sequences

| Name | SEQ ID NO |
|---|---|
| CAR123-2 NT | SEQ ID NO: 248 |
| CAR123-2 AA | SEQ ID NO: 249 |
| CAR123-2 scFv | SEQ ID NO: 250 |
| CAR123-2 VH | SEQ ID NO: 251 |
| CAR123-2 VL | SEQ ID NO: 252 |
| CAR123-3 NT | SEQ ID NO: 253 |
| CAR123-3 AA | SEQ ID NO: 254 |
| CAR123-3 scFv | SEQ ID NO: 255 |
| CAR123-3 VH | SEQ ID NO: 256 |
| CAR123-3 VL | SEQ ID NO: 257 |
| CAR123-4 NT | SEQ ID NO: 258 |
| CAR123-4 AA | SEQ ID NO: 259 |
| CAR123-4 scFv | SEQ ID NO: 260 |
| CAR123-4 VH | SEQ ID NO: 261 |
| CAR123-4 VL | SEQ ID NO: 262 |
| CAR123-1 NT | SEQ ID NO: 263 |
| CAR123-1 AA | SEQ ID NO: 264 |
| CAR123-1 scFv | SEQ ID NO: 265 |
| CAR123-1 VH | SEQ ID NO: 266 |
| CAR123-1 VL | SEQ ID NO: 267 |

TABLE 13

Humanized CD123 CAR Sequences

| Name | SEQ ID NO |
|---|---|
| hzCAR123-1 NT | 268 |
| hzCAR123-1 AA | 269 |
| hzCAR123-1 scFv | 270 |
| hzCAR123-1 VH | 271 |
| hzCAR123-1 VL | 272 |
| hzCAR123-2 NT | 273 |
| hzCAR123-2 AA | 274 |
| hzCAR123-2 scFv | 275 |
| hzCAR123-2 VH | 271 |
| hzCAR123-2 VL | 276 |
| hzCAR123-3 NT | 277 |
| hzCAR123-3 AA | 278 |
| hzCAR123-3 scFv | 279 |
| hzCAR123-3 VH | 271 |
| hzCAR123-3 VL | 280 |
| hzCAR123-4 NT | 281 |
| hzCAR123-4 AA | 282 |
| hzCAR123-4 scFv | 283 |
| hzCAR123-4 VH | 271 |
| hzCAR123-4 VL | 284 |
| hzCAR123-5 NT | 285 |
| hzCAR123-5 AA | 286 |
| hzCAR123-5 scFv | 287 |
| hzCAR123-5 VH | 271 |
| hzCAR123-5 VL | 272 |
| hzCAR123-6 NT | 288 |
| hzCAR123-6 AA | 289 |
| hzCAR123-6 scFv | 290 |
| hzCAR123-6 VH | 271 |
| hzCAR123-6 VL | 276 |
| hzCAR123-7 NT | 291 |
| hzCAR123-7 AA | 292 |
| hzCAR123-7 scFv | 293 |
| hzCAR123-7 VH | 271 |
| hzCAR123-7 VL | 280 |
| hzCAR123-8 NT | 294 |
| hzCAR123-8 AA | 295 |
| hzCAR123-8 scFv | 296 |
| hzCAR123-8 VH | 271 |
| hzCAR123-8 VL | 284 |
| hzCAR123-9 NT | 297 |
| hzCAR123-9 AA | 298 |
| hzCAR123-9 scFv | 299 |
| hzCAR123-9 VH | 300 |
| hzCAR123-10 VL | 272 |
| hzCAR123-10 NT | 301 |
| hzCAR123-10 AA | 302 |
| hzCAR123-10 scFv | 303 |
| hzCAR123-10 VH | 300 |
| hzCAR123-10 VL | 276 |
| hzCAR123-11 NT | 304 |

TABLE 13-continued

Humanized CD123 CAR Sequences

| Name | SEQ ID NO |
|---|---|
| hzCAR123-11 AA | 305 |
| hzCAR123-11 scFv | 306 |
| hzCAR123-11 VH | 300 |
| hzCAR123-11 VL | 280 |
| hzCAR123-12 NT | 307 |
| hzCAR123-12 AA | 308 |
| hzCAR123-12 scFv | 309 |
| hzCAR123-12 VH | 300 |
| hzCAR123-12 VL | 284 |
| hzCAR123-13 NT | 310 |
| hzCAR123-13 AA | 311 |
| hzCAR123-13 scFv | 312 |
| hzCAR123-13 VH | 300 |
| hzCAR123-13 VL | 272 |
| hzCAR123-14 NT | 313 |
| hzCAR123-14 AA | 314 |
| hzCAR123-14 scFv | 315 |
| hzCAR123-14 VH | 300 |
| hzCAR123-14 VL | 276 |
| hzCAR123-15 NT | 316 |
| hzCAR123-15 AA | 317 |
| hzCAR123-15 scFv | 318 |
| hzCAR123-15 VH | 300 |
| hzCAR123-15 VL | 280 |
| hzCAR123-16 NT | 319 |
| hzCAR123-16 AA | 320 |
| hzCAR123-16 scFv | 321 |
| hzCAR123-16 VH | 300 |
| hzCAR123-16 VL | 284 |
| hzCAR123-17 NT | 322 |
| hzCAR123-17 AA | 323 |
| hzCAR123-17 scFv | 324 |
| hzCAR123-17 VH | 325 |
| hzCAR123-17 VL | 272 |
| hzCAR123-18 NT | 326 |
| hzCAR123-18 AA | 327 |
| hzCAR123-18 scFv | 328 |
| hzCAR123-18 VH | 325 |
| hzCAR123-18 VL | 276 |
| hzCAR123-19 NT | 329 |
| hzCAR123-19 AA | 330 |
| hzCAR123-19 scFv | 331 |
| hzCAR123-19 VH | 325 |
| hzCAR123-19 VL | 280 |
| hzCAR123-20 NT | 332 |
| hzCAR123-20 AA | 333 |
| hzCAR123-20 scFv | 334 |
| hzCAR123-20 VH | 325 |
| hzCAR123-20 VL | 284 |
| hzCAR123-21 NT | 335 |
| hzCAR123-21 AA | 336 |
| hzCAR123-21 scFv | 337 |
| hzCAR123-21 VH | 325 |
| hzCAR123-21 VL | 272 |
| hzCAR123-22 NT | 338 |
| hzCAR123-22 AA | 339 |
| hzCAR123-22 scFv | 340 |
| hzCAR123-22 VH | 325 |
| hzCAR123-22 VL | 276 |
| hzCAR123-23 NT | 341 |
| hzCAR123-23 AA | 342 |
| hzCAR123-23 scFv | 343 |
| hzCAR123-23 VH | 325 |
| hzCAR123-23 VL | 280 |
| hzCAR123-24 NT | 344 |
| hzCAR123-24 AA | 345 |
| hzCAR123-24 scFv | 346 |
| hzCAR123-24 VH | 325 |
| hzCAR123-24 VL | 284 |
| hzCAR123-25 NT | 347 |
| hzCAR123-25 AA | 348 |
| hzCAR123-25 scFv | 349 |
| hzCAR123-25 VH | 350 |
| hzCAR123-25 VL | 272 |
| hzCAR123-26 NT | 351 |
| hzCAR123-26 AA | 352 |

TABLE 13-continued

Humanized CD123 CAR Sequences

| Name | SEQ ID NO |
|---|---|
| hzCAR123-26 scFv | 353 |
| hzCAR123-26 VH | 350 |
| hzCAR123-26 VL | 276 |
| hzCAR123-27 NT | 354 |
| hzCAR123-27 AA | 355 |
| hzCAR123-27 scFv | 356 |
| hzCAR123-27 VH | 350 |
| hzCAR123-27 VL | 280 |
| hzCAR123-28 NT | 357 |
| hzCAR123-28 AA | 358 |
| hzCAR123-28 scFv | 359 |
| hzCAR123-28 VH | 350 |
| hzCAR123-28 VL | 284 |
| hzCAR123-29 NT | 360 |
| hzCAR123-29 AA | 361 |
| hzCAR123-29 scFv | 362 |
| hzCAR123-29 VH | 350 |
| hzCAR123-29 VL | 272 |
| hzCAR123-30 NT | 363 |
| hzCAR123-30 AA | 364 |
| hzCAR123-30 scFv | 365 |
| hzCAR123-30 VH | 350 |
| hzCAR123-30 VL | 276 |
| hzCAR123-31 NT | 366 |
| hzCAR123-31 AA | 367 |
| hzCAR123-31 scFv | 368 |
| hzCAR123-31 VH | 350 |
| hzCAR123-31 VL | 280 |
| hzCAR123-32 NT | 369 |
| hzCAR123-32 AA | 370 |
| hzCAR123-32 scFv | 371 |
| hzCAR123-32 VH | 350 |
| hzCAR123-32 VL | 284 |

In embodiments, a CAR molecule described herein comprises a scFv that specifically binds to CD123, and does not contain a leader sequence, e.g., the amino acid sequence SEQ ID NO: 64. Table 14 below provides amino acid and nucleotide sequences for CD123 scFv sequences that do not contain a leader sequence SEQ ID NO: 64.

TABLE 14

CD123 CAR scFv sequences

| Name | SEQ ID NO |
|---|---|
| CAR123-2 scFv - NT | 372 |
| CAR123-2 scFv - AA | 373 |
| CAR123-2 ORF-free NT | 374 |
| CAR123-3 scFv - NT | 375 |
| CAR123-3 scFv - AA | 376 |
| CAR123-4 scFv - NT | 377 |
| CAR123-4 scFv - AA | 378 |
| CAR123-1 scFv-AA | 379 |
| hzCAR123-1 scFv | 380 |
| hzCAR123-2 scFv | 381 |
| hzCAR123-3 scFv | 382 |
| hzCAR123-4 scFv | 383 |
| hzCAR123-5 scFv | 384 |
| hzCAR123-6 scFv | 385 |
| hzCAR123-7 scFv | 386 |
| hzCAR123-8 scFv | 387 |
| hzCAR123-9 scFv | 388 |
| hzCAR123-10 scFv | 389 |
| hzCAR123-11 scFv | 390 |
| hzCAR123-12 scFv | 391 |
| hzCAR123-13 scFv | 392 |
| hzCAR123-14 scFv | 393 |
| hzCAR123-15 scFv | 394 |
| hzCAR123-16 scFv | 395 |
| hzCAR123-17 scFv | 396 |
| hzCAR123-18 scFv | 397 |

TABLE 14-continued

CD123 CAR scFv sequences

| Name | SEQ ID NO |
| --- | --- |
| hzCAR123-19 scFv | 398 |
| hzCAR123-20 scFv | 399 |
| hzCAR123-21 scFv | 400 |
| hzCAR123-22 scFv | 401 |
| hzCAR123-23 scFv | 402 |
| hzCAR123-24 scFv | 403 |
| hzCAR123-25 scFv | 404 |
| hzCAR123-26 scFv | 405 |
| hzCAR123-27 scFv | 406 |
| hzCAR123-28 scFv | 407 |
| hzCAR123-29 scFv | 408 |
| hzCAR123-30 scFv | 409 |
| hzCAR123-31 scFv | 410 |
| hzCAR123-32 scFv | 411 |

In other embodiments, the CAR-expressing cells can specifically bind to CD123, e.g., can include a CAR molecule (e.g., any of the CAR123-1 or CAR123-4 and hzCAR123-1 to hzCAR123-32), or an antigen binding domain according to Tables 2, 6, and 9 of WO2016/028896, incorporated herein by reference. The amino acid and nucleotide sequences encoding the CD123 CAR molecules and antigen binding domains (e.g., including one, two, three VH CDRs; and one, two, three VL CDRs according to Kabat or Chothia), as specified in WO2016/028896, are incorporated herein by reference in their entireties.

EGFRvIII CAR

In other embodiments, the CAR-expressing cells can specifically bind to EGFRvIII, e.g., can include a CAR molecule, or an antigen binding domain according to Table 2 or SEQ ID NO:11 of WO 2014/130657, incorporated herein by reference. Exemplary amino acid and nucleotide sequences encoding the EGFRvIII CAR molecules and antigen binding domains (e.g., including one, two, three VH CDRs; and one, two, three VL CDRs according to Kabat or Chothia) are provided in WO 2014/130657. Exemplary anti-EGFRvIII CAR sequences may comprise a CDR, a variable region, an scFv, or a full-length CAR sequence of a sequence disclosed in Table 33 (or a sequence at least about 85%, 90%, 95%, 99% or more identical thereto, and/or having one, two, three or more substitutions, insertions, deletions, or modifications).

TABLE 33

EGFRvIII CAR sequences.

| Name | SEQ ID NO: |
| --- | --- |
| CAR 1 | |
| CAR1 scFv domain | SEQ ID NO: 1451 |
| CAR1 scFv domain nt | SEQ ID NO: 1452 |
| CAR1 Soluble scFv - nt | SEQ ID NO: 1453 |
| CAR1 Soluble scFv - aa | SEQ ID NO: 1454 |
| CAR 1 - Full - nt lentivirus | SEQ ID NO: 1455 |
| CAR 1 - Full - aa | SEQ ID NO: 1456 |
| CAR 2 | |
| CAR2 scFv domain | SEQ ID NO: 1457 |
| CAR2 scFv domain - nt | SEQ ID NO: 1458 |
| CAR2 - Soluble scFv - nt | SEQ ID NO: 1459 |
| CAR2 - Soluble scFv - aa | SEQ ID NO: 1460 |
| CAR 2 - Full-nt | SEQ ID NO: 1461 |
| CAR 2 - Full - aa | SEQ ID NO: 1462 |

TABLE 33-continued

EGFRvIII CAR sequences.

| Name | SEQ ID NO: |
| --- | --- |
| CAR 3 | |
| CAR3 scFv domain | SEQ ID NO: 1463 |
| CAR3 scFv domain nt | SEQ ID NO: 1464 |
| CAR 3 - Soluble scFv - nt | SEQ ID NO: 1465 |
| CAR 3 - Soluble scFv - aa | SEQ ID NO: 1466 |
| CAR 3 - Full - nt | SEQ ID NO: 1467 |
| CAR 3 - Full - aa | SEQ ID NO: 1468 |
| CAR 4 | |
| CAR4 scFv domain | SEQ ID NO: 1469 |
| CAR4 scFv domain nt | SEQ ID NO: 1470 |
| CAR4 - Soluble scFv - nt | SEQ ID NO: 1471 |
| CAR4 - Soluble scFv - aa | SEQ ID NO: 1472 |
| CAR 4 - Full - nt | SEQ ID NO: 1473 |
| CAR 4 - Full - aa | SEQ ID NO: 1474 |
| CAR 5 | |
| CAR5 scFv domain | SEQ ID NO: 1475 |
| CAR5 scFv domain nt | SEQ ID NO: 1476 |
| CAR5 - Soluble scFv - nt | SEQ ID NO: 1477 |
| CAR5 - Soluble scFv - aa | SEQ ID NO: 1478 |
| CAR 5 - Full - nt | SEQ ID NO: 1479 |
| CAR 5 - Full - aa | SEQ ID NO: 1480 |
| CAR 6 | |
| CAR6 scFv domain | SEQ ID NO: 1481 |
| CAR6 scFv domain nt | SEQ ID NO: 1482 |
| CAR6 - Soluble scFv - nt | SEQ ID NO: 1483 |
| CAR6 - Soluble scFv - aa | SEQ ID NO: 1484 |
| CAR6 -Full - nt | SEQ ID NO: 1485 |
| CAR6 -Full - aa | SEQ ID NO: 1486 |
| CAR 7 | |
| CAR7 scFv domain | SEQ ID NO: 1487 |
| CAR7 scFv domain nt | SEQ ID NO: 1488 |
| CAR7 - Soluble scFv - nt | SEQ ID NO: 1489 |
| CAR7 - Soluble scFv - aa | SEQ ID NO: 1490 |
| CAR 7 Full - nt | SEQ ID NO: 1491 |
| CAR 7 Full - aa | SEQ ID NO: 1492 |
| CAR 8 | |
| CAR8 scFv domain | SEQ ID NO: 1493 |
| CAR8 scFv domain nt | SEQ ID NO: 1494 |
| CAR8 - Soluble scFv - nt | SEQ ID NO: 1495 |
| CAR8 - Soluble scFv - aa | SEQ ID NO: 1496 |
| CAR 8 - Full - nt | SEQ ID NO: 1497 |
| CAR 8 - Full - aa | SEQ ID NO: 1498 |
| CAR 9 | Mouse anti-EGFRvIII clone 3C10 |
| CAR9 scFv domain | SEQ ID NO: 1499 |
| CAR9 scFv domain nt | SEQ ID NO: 1500 |
| CAR9 - Soluble scFv - nt | SEQ ID NO: 1501 |
| CAR9 - Soluble scFv - aa | SEQ ID NO: 1502 |
| CAR 9 - Full - nt | SEQ ID NO: 1503 |
| CAR 9 - Full - aa | SEQ ID NO: 1504 |
| CAR10 | Anti-EGFRvIII clone 139 |
| CAR10 scFv domain | SEQ ID NO: 1505 |
| CAR9 scFv domain nt | SEQ ID NO: 1506 |
| CAR10 - Soluble scFv - nt | SEQ ID NO: 1507 |
| CAR10 - Soluble scFv - aa | SEQ ID NO: 1508 |
| CAR 10 Full - nt | SEQ ID NO: 1509 |
| CAR 10 Full - aa | SEQ ID NO: 1510 |

CD33 CAR

In other embodiments, the CAR-expressing cells can specifically bind to CD33, e.g., can include a CAR molecule (e.g., any of CAR33-1 to CAR-33-9), or an antigen binding domain according to Table 2 or 9 of WO2016/014576, incorporated herein by reference. Exemplary amino acid and nucleotide sequences encoding the CD33 CAR molecules and antigen binding domains (e.g., including one, two, three VH CDRs; and one, two, three VL CDRs according to Kabat or Chothia) are provided in WO2016/014576.

Mesothelin CAR

In some embodiments, the CAR-expressing cells can specifically bind to mesothelin, e.g., can include a CAR molecule, or an antigen binding domain according to Tables 2-3 of WO 2015/090230, incorporated herein by reference. Exemplary amino acid and nucleotide sequences encoding the mesothelin CAR molecules and antigen binding domains (e.g., including one, two, three VH CDRs; and one, two, three VL CDRs according to Kabat or Chothia) are provided in WO 2015/090230. Exemplary anti-mesothelin CAR sequences may comprise a CDR, a variable region, an scFv, or a full-length CAR sequence of a sequence disclosed in Table 34 (or a sequence at least about 85%, 90%, 95%, 99% or more identical thereto, and/or having one, two, three or more substitutions, insertions, deletions, or modifications).

TABLE 34

Mesothelin CAR sequences. Amino acid sequences of human scFvs and CARs that bind to mesothelin (bold underline is the leader sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| SEQ ID NO: 1511 | M1 (ScFv domain) | QVQLQQSGAEVKKPGASVKVSCKASGYTFTGYYMHWVRQAPGQGLEWMGRINPNSGGTNY AQKFQGRVTMTRDTSISTAYMELSRLRSEDTAVYYCARGRYYGMDVWGQGTMVTVSSGGG GSGGGGSGGGGSGGGGSEIVLTQSPATLSLSPGERATISCRASQSVSSNFAWYQQRPGQA PRLLIYDASNRATGIPPRFSGSGSGTDFTLTISSLEPEDFAAYYCHQRSNWLYTFGQGTK VDIK |
| SEQ ID NO: 1512 | M1 (full) >ZA53-27BC (M1 ZA53-27BC R001-A11126161) | MALPVTALLLPLALLLHAARPQVQLQQSGAEVKKPGASVKVSCKASGYTFTGYYMHWVRQ APGQGLEWMGRINPNSGGTNYAQKFQGRVTMTRDTSISTAYMELSRLRSEDTAVYYCARG RYYGMDVWGQGTMVTVSSGGGGSGGGGSGGGGSEIVLTQSPATLSLSPGERATIS CRASQSVSSNFAWYQQRPGQAPRLLIYDASNRATGIPPRFSGSGSGTDFTLTISSLEPED FAAYYCHQRSNWLYTFGQGTKVDIKTTTPAPRPPTPAPTIASQPLSLRPEACRPAAGGAV HTRGLDFACDIYIWAPLAGTCGVLLLSLVITLYCKRGRKKLLYIFKQPFMRPVQTTQEED GCSCRFPEEEEGGCELRVKFSRSADAPAYKQGQNQLYNELNLGRREEYDVLDKRRGRDPE MGGKPRRKNPQEGLYNELQKDKMAEAYSEIGMKGERRRGKGHDGLYQGLSTATKDTYDAL HMQALPPR |
| SEQ ID NO: 1513 | M2 (ScFv domain) | QVQLVQSGAEVKKPGASVKVSCKASGYTFTGYYMHWVRQAPGQGLEWMGWINPNSGGTNY AQKFQGRVTMTRDTSISTAYMELSRLRSDDTAVYYCARDLRRTVVTPRAYYGMDVWGQGT TVTVSSGGGGSGGGGSGGGGSGGGGSDIQLTQSPSTLSASVGDRVTITCQASQDISNSLN WYQQKAGKAPKLLIYDASTLETGVPSRFSGSGSGTDFSFTISSLQPEDIATYYCQQHDNL PLTFGQGTKVEIK |
| SEQ ID NO: 1514 | M2 (full) >FA56-26RC (M2 FA56-26RC R001-A10126162) | MALPVTALLLPLALLLHAARPQVQLVQSGAEVKKPGASVKVSCKASGYTFTGYYMHWVRQ APGQGLEWMGWINPNSGGTNYAQKFQGRVTMTRDTSISTAYMELSRLRSDDTAVYYCARD LRRTVVTPRAYYGMDVWGQGTTVTVSSGGGGSGGGGSGGGGSGGGGSDIQLTQSPSTLSA SVGDRVTITCQASQDISNSLNWYQQKAGKAPKLLIYDASTLETGVPSRFSGSGSGTDFSF TISSLQPEDIATYYCQQHDNLPLTFGQGTKVEIKTTTPAPRPPTPAPTIASQPLSLRPEA CRPAAGGAVHTRGLDFACDIYIWAPLAGTCGVLLLSLVITLYCKRGRKKLLYIFKQPFMR PVQTTQEEDGCSCRFPEEEEGGCELRVKFSRSADAPAYKQGQNQLYNELNLGRREEYDVL DKRRGRDPEMGGKPRRKNPQEGLYNELQKDKMAEAYSEIGMKGERRRGKGHDGLYQGLST ATKDTYDALHMQALPPR |
| SEQ ID NO: 1515 | M3 (ScFv domain) | QVQLVQSGAEVKKPGAPVKVSCKASGYTFTGYYMHWVRQAPGQGLEWMGWINPNSGGTNY AQKFQGRVTMTRDTSISTAYMELSRLRSDDTAVYYCARGEWDGSYYYDYWGQGTLVTVSS GGGGSGGGGSGGGGSGGGGSDIVLTQTPSSLSASVGDRVTITCRASQSINTYLNWYQHKP GKAPKLLIYAASSLQSGVPSRFSGSGSGTDFTLTISSLQPEDFATYYCQQSFSPLTFGGG TKLEIK |
| SEQ ID NO: 1516 | M3 >VA58-21LC (M3 VA58-21LC R001-A1126163) | MALPVTALLLPLALLLHAARPQVQLVQSGAEVKKPGAPVKVSCKASGYTFTGYYMHWVRQ APGQGLEWMGWINPNSGGTNYAQKFQGRVTMTRDTSISTAYMELSRLRSDDTAVYYCARG EWDGSYYYDYWGQGTLVTVSSGGGGSGGGGSGGGGSGGGGSDIVLTQTPSSLSASVGDRV TITCRASQSINTYLNWYQHKPGKAPKLLIYAASSLQSGVPSRFSGSGSGTDFTLTISSLQ PEDFATYYCQQSFSPLTFGGGTKLEIKTTTPAPRPPTPAPTIASQPLSLRPEACRPAAGG AVHTRGLDFACDIYIWAPLAGTCGVLLLSLVITLYCKRGRKKLLYIFKQPFMRPVQTTQE EDGCSCRFPEEEEGGCELRVKFSRSADAPAYKQGQNQLYNELNLGRREEYDVLDKRRGRD PEMGGKPRRKNPQEGLYNELQKDKMAEAYSEIGMKGERRRGKGHDGLYQGLSTATKDTYD ALHMQALPPR |
| SEQ ID NO: 1517 | M4 (ScFv domain) | QVQLVESGGGLVQPGGSLRLSCAASGFTFSSYWMHWVRQVPGKGLVWVSRINTDGSTTTY ADSVEGRFTISRDNAKNTLYLQMNSLRDDDTAVYYCVGGHWAVWGQGTTVTVSSGGGGSG GGGSGGGGSGGGGSDIQMTQSPSTLSASVGDRVTITCRASQSISDRLAWYQQKPGKAPKL LIYKASSLESGVPSRFSGSGSGTEFTLTISSLQPDDFAVYYCQQYGHLPMYTFGQGTKVE IK |
| SEQ ID NO: 1518 | M4 >DP37-071C (M4 | MALPVTALLLPLALLLHAARPQVQLVESGGGLVQPGGSLRLSCAASGFTFSSYWMHWVRQ VPGKGLVWVSRINTDGSTTTYADSVEGRFTISRDNAKNTLYLQMNSLRDDDTAVYYCVGG HWAVWGQGTTVTVSSGGGGSGGGGSGGGGSGGGGSDIQMTQSPSTLSASVGDRVTITCRA SQSISDRLAWYQQKPGKAPKLLIYKASSLESGVPSRFSGSGSGTEFTLTISSLQPDDFAV |

TABLE 34-continued

Mesothelin CAR sequences. Amino acid sequences of human scFvs and
CARs that bind to mesothelin (bold underline is the leader sequence).
In the case of the scFvs, the remaining amino acids are the heavy
chain variable region and light chain variable regions, with each
of the HC CDRs (HC CDR1, HC CDR2, HC CDR3) and LC CDRs (LC CDR1,
LC CDR2, LCCDR3) underlined. In the case of the CARs, the further
remaining amino acids are the remaining amino acids of the CARs.

| SEQ ID NO: | Description | Amino Acid Sequence |
|---|---|---|
| | DP37-071C R001-C6126164) | YYCQQYGHLPMYTFGQGTKVEIKTTTPAPRPPTPAPTIASQPLSLRPEACRPAAGGAVHT RGLDFACDIYIWAPLAGTCGVLLLSLVITLYCKRGRKKLLYIFKQPFMRPVQTTQEEDGC SCRFPEEEEGGCELRVKFSRSADAPAYKQGQNQLYNELNLGRREEYDVLDKRRGRDPEMG GKPRRKNPQEGLYNELQKDKMAEAYSEIGMKGERRRGKHDGLYQGLSTATKDTYDALHM QALPPR |
| SEQ ID NO: 1519 | M5 (ScFv domain) | QVQLVQSGAEVEKPGASVKVSCKASGYTFTDYYMHWVRQAPGQGLEWMGWINPNSGGTNY AQKFQGRVTMTRDTSISTAYMELSRLRSDDTAVYYCASGWDFDYWGQGTLVTVSSGGGGS GGGGSGGGGSGGGGSDIVMTQSPSSLSASVGDRVTITCRASQSIRYYLSWYQQKPGKAPK LLIYTASILQNGVPSRFSGSGSGTDFTLTISSLQPEDFATYYCLQTYTTPDFGPGTKVEI K |
| SEQ ID NO: 1520 | M5 >XP31- 20LC (M5 XP31- 20LC R001- B4126165) | MALPVTALLLPLALLLHAARPQVQLVQSGAEVEKPGASVKVSCKASGYTFTDYYMHWVRQ APGQGLEWMGWINPNSGGTNYAQKFQGRVTMTRDTSISTAYMELSRLRSDDTAVYYCASG WDFDYWGQGTLVTVSSGGGGSGGGGSGGGGSGGGGSDIVMTQSPSSLSASVGDRVTITCR ASQSIRYYLSWYQQKPGKAPKLLIYTASILQNGVPSRFSGSGSGTDFTLTISSLQPEDFA TYYCLQTYTTPDFGPGTKVEIKTTTPAPRPPTPAPTIASQPLSLRPEACRPAAGGAVHTR GLDFACDIYIWAPLAGTCGVLLLSLVITLYCKRGRKKLLYIFKQPFMRPVQTTQEEDGCS CRFPEEEEGGCELRVKFSRSADAPAYKQGQNQLYNELNLGRREEYDVLDKRRGRDPEMGG KPRRKNPQEGLYNELQKDKMAEAYSEIGMKGERRRGKHDGLYQGLSTATKDTYDALHMQ ALPPR |
| SEQ ID NO: 1521 | M6 (ScFv domain) | QVQLVQSGAEVKKPGASVKVSCKASGYTFTSYYMHWVRQAPGQGLEWMGIINPSGGSTSY AQKFQGRVTMTRDTSTSTVYMELSSLRSEDTAVYYCARYRLIAVAGDYYYYGMDVWGQGT MVTVSSGGGGSGGGGSGGGGSGGGGSDIQMTQSPSSVSASVGDRVTITCRASQGVGRWLA WYQQKPGTAPKLLIYAASTLQSGVPSRFSGSGSGTDFTLTINNLQPEDFATYYCQQANSF PLTFGGGTRLEIK |
| SEQ ID NO: 1522 | M6 >FE10- 06ID (M6 46FE10- 06ID R001- A4126166) | MALPVTALLLPLALLLHAARPQVQLVQSGAEVKKPGASVKVSCKASGYTFTSYYMHWVRQ APGQGLEWMGIINPSGGSTSYAQKFQGRVTMTRDTSTSTVYMELSSLRSEDTAVYYCARY RLIAVAGDYYYYGMDVWGQGTMVTVSSGGGGSGGGGSGGGGSGGGGSDIQMTQSPSSVSA SVGDRVTITCRASQGVGRWLAWYQQKPGTAPKLLIYAASTLQSGVPSRFSGSGSGTDFTL TINNLQPEDFATYYCQQANSFPLTFGGGTRLEIKTTTPAPRPPTPAPTIASQPLSLRPEA CRPAAGGAVHTRGLDFACDIYIWAPLAGTCGVLLLSLVITLYCKRGRKKLLYIFKQPFMR PVQTTQEEDGCSCRFPEEEEGGCELRVKFSRSADAPAYKQGQNQLYNELNLGRREEYDVL DKRRGRDPEMGGKPRRKNPQEGLYNELQKDKMAEAYSEIGMKGERRRGKHDGLYQGLST ATKDTYDALHMQALPPR |
| SEQ ID NO: 1523 | M7 (ScFv domain) | QVQLVQSGGGVVQPGRSLRLSCAASGFTFSSYAMHWVRQAPGKGLEWVAVISYDGSNKYY ADSVKGRFTISRDNSKNTLYLQMNSLRAEDTAVYYCARWKVSSSSPAFDYWGQGTLVTVS SGGGGSGGGGSGGGGSGGGGSEIVLTQSPATLSLSPGERAILSCRASQSVYTKYLGWYQQ KPGQAPRLLIYDASTRATGIPDRFSGSGSGTDFTLTINRLEPEDFAVYYCQHYGGSPLIT FGQGTRLEIK |
| SEQ ID NO: 1524 | M7 >VE12- 01CD (M7 VE12- 01CD R001- A5126167 ) | MALPVTALLLPLALLLHAARPQVQLVQSGGGVVQPGRSLRLSCAASGFTFSSYAMHWVRQ APGKGLEWVAVISYDGSNKYYADSVKGRFTISRDNSKNTLYLQMNSLRAEDTAVYYCARW KVSSSSPAFDYWGQGTLVTVSSGGGGSGGGGSGGGGSGGGGSEIVLTQSPATLSLSPGER AILSCRASQSVYTKYLGWYQQKPGQAPRLLIYDASTRATGIPDRFSGSGSGTDFTLTINR LEPEDFAVYYCQHYGGSPLITFGQGTRLEIKTTTPAPRPPTPAPTIASQPLSLRPEACRP AAGGAVHTRGLDFACDIYIWAPLAGTCGVLLLSLVITLYCKRGRKKLLYIFKQPFMRPVQ TTQEEDGCSCRFPEEEEGGCELRVKFSRSADAPAYKQGQNQLYNELNLGRREEYDVLDKR RGRDPEMGGKPRRKNPQEGLYNELQKDKMAEAYSEIGMKGERRRGKHDGLYQGLSTATK DTYDALHMQALPPR |
| SEQ ID NO: 1525 | M8 (ScFv domain) | QVQLQQSGAEVKKPGASVKVSCKTSGYPFTGYSLHWVRQAPGQGLEWMGWINPNSGGTNY AQKFQGRVTMTRDTSISTAYMELSRLRSDDTAVYYCARDHYGGNSLFYWGQGTLVTVSSG GGGSGGGGSGGGGSGGGGSDIQLTQSPSSISASVGDTVSITCRASQDSGTWLAWYQQKPG KAPNLLMYDASTLEDGVPSRFSGSASGTEFTLTVNRLQPEDSATYYCQQYNSYPLTFGGG TKVDIK |
| SEQ ID NO: 1526 | M8 >LE13- 05XD (M8 LE13- 05XD R001- E5126168) | MALPVTALLLPLALLLHAARPQVQLQQSGAEVKKPGASVKVSCKTSGYPFTGYSLHWVRQ APGQGLEWMGWINPNSGGTNYAQKFQGRVTMTRDTSISTAYMELSRLRSDDTAVYYCARD HYGGNSLFYWGQGTLVTVSSGGGGSGGGGSGGGGSGGGGSDIQLTQSPSSISASVGDTVS ITCRASQDSGTWLAWYQQKPGKAPNLLMYDASTLEDGVPSRFSGSASGTEFTLTVNRLQP EDSATYYCQQYNSYPLTFGGGTKVDIKTTTPAPRPPTPAPTIASQPLSLRPEACRPAAGG AVHTRGLDFACDIYIWAPLAGTCGVLLLSLVITLYCKRGRKKLLYIFKQPFMRPVQTTQE EDGCSCRFPEEEEGGCELRVKFSRSADAPAYKQGQNQLYNELNLGRREEYDVLDKRRGRD PEMGGKPRRKNPQEGLYNELQKDKMAEAYSEIGMKGERRRGKHDGLYQGLSTATKDTYD ALHMQALPPR |

TABLE 34-continued

Mesothelin CAR sequences. Amino acid sequences of human scFvs and
CARs that bind to mesothelin (bold underline is the leader sequence).
In the case of the scFvs, the remaining amino acids are the heavy
chain variable region and light chain variable regions, with each
of the HC CDRs (HC CDR1, HC CDR2, HC CDR3) and LC CDRs (LC CDR1,
LC CDR2, LCCDR3) underlined. In the case of the CARs, the further
remaining amino acids are the remaining amino acids of the CARs.

| SEQ ID NO: | Description | Amino Acid Sequence |
|---|---|---|
| SEQ ID NO: 1527 | M9 (ScFv domain) | QVQLVQSGAEVKKPGASVEVSCKASGYTFTSYYMHWVRQAPGQGLEWMGIINPSGGSTGY AQKFQGRVTMTRDTSTSTVHMELSSLRSEDTAVYYCARGGYSSSSDAFDIWGQGTMVTVS SGGGGSGGGGSGGGGSGGGGSDIQMTQSPPSLSASVGDRVTITCRASQDISSALAWYQQK PGTPPKLLIYDASSLESGVPSRFSGSGSGTDFTLTISSLQPEDFATYYCQQFSSYPLTFG GGTRLEIK |
| SEQ ID NO: 1528 | M9 >BE15-00SD (M9 BE15-00SD R001-A3126169) | MALPVTALLLPLALLLHAARPQVQLVQSGAEVKKPGASVEVSCKASGYTFTSYYMHWVRQ APGQGLEWMGIINPSGGSTGYAQKFQGRVTMTRDTSTSTVHMELSSLRSEDTAVYYCARG GYSSSSDAFDIWGQGTMVTVSSGGGGSGGGGSGGGGSGGGGSDIQMTQSPPSLSASVGDR VTITCRASQDISSALAWYQQKPGTPPKLLIYDASSLESGVPSRFSGSGSGTDFTLTISSL QPEDFATYYCQQFSSYPLTFGGGTRLEIKTTTPAPRPPTPAPTIASQPLSLRPEACRPAA GGAVHTRGLDFACDIYIWAPLAGTCGVLLLSLVITLYCKRGRKKLLYIFKQPFMRPVQTT QEEDGCSCRFPEEEEGGCELRVKFSRSADAPAYKQGQNQLYNELNLGRREEYDVLDKRRG RDPEMGGKPRRKNPQEGLYNELQKDKMAEAYSEIGMKGERRRGKGHDGLYQGLSTATKDT YDALHMQALPPR |
| SEQ ID NO: 1529 | M10 (ScFv domain) | QVQLVQSGAEVKKPGASVKVSCKASGYTFTSYGISWVRQAPGQGLEWMGWISAYNGNTNY AQKLQGRVTMTTDTSTSTAYMELRSLRSDDTAVYYCARVAGGIYYYYGMDVWGQGTTITV SSGGGGSGGGGSGGGGSGGGGSDIVMTQTPDSLAVSLGERATISCKSSHSVLYNRNNKNY LAWYQQKPGQPPKLLFYWASTRKSGVPDRFSGSGSGTDFTLTISSLQPEDFATYFCQQTQ TFPLTFGQGTRLEIN |
| SEQ ID NO: 1530 | M10 >RE16-05MD (M10 RE16-05MD R001-D10126170) | MALPVTALLLPLALLLHAARPQVQLVQSGAEVKKPGASVKVSCKASGYTFTSYGISWVRQ APGQGLEWMGWISAYNGNTNYAQKLQGRVTMTTDTSTSTAYMELRSLRSDDTAVYYCARV AGGIYYYYGMDVWGQGTTITVSSGGGGSGGGGSGGGGSGGGGSDIVMTQTPDSLAVSLGE RATISCKSSHSVLYNRNNKNYLAWYQQKPGQPPKLLFYWASTRKSGVPDRFSGSGSGTDF TLTISSLQPEDFATYFCQQTQTFPLTFGQGTRLEINTTTPAPRPPTPAPTIASQPLSLRP EACRPAAGGAVHTRGLDFACDIYIWAPLAGTCGVLLLSLVITLYCKRGRKKLLYIFKQPF MRPVQTTQEEDGCSCRFPEEEEGGCELRVKFSRSADAPAYKQGQNQLYNELNLGRREEYD VLDKRRGRDPEMGGKPRRKNPQEGLYNELQKDKMAEAYSEIGMKGERRRGKGHDGLYQGL STATKDTYDALHMQALPPR |
| SEQ ID NO: 1531 | M11 (ScFv domain) | QVQLQQSGAEVKKPGASVKVSCKASGYTFTGYYMHWVRQAPGQGLEWMGWINPNSGGTNY AQNFQGRVTMTRDTSISTAYMELRRLRSDDTAVYYCASGWDFDYWGQGTLVTVSSGGGGS GGGGSGGGGSGGGGSDIRMTQSPSSLSASVGDRVTITCRASQSIRYYLSWYQQKPGKAPK LLIYTASILQNGVPSRFSGSGSGTDFTLTISSLQPEDFATYYCLQTYTTPDFGPGTKVEI K |
| SEQ ID NO: 1532 | M11 >NE10-19WD (M11 NE10-19WD R001-G2126171) | MALPVTALLLPLALLLHAARPQVQLQQSGAEVKKPGASVKVSCKASGYTFTGYYMHWVRQ APGQGLEWMGWINPNSGGTNYAQNFQGRVTMTRDTSISTAYMELRRLRSDDTAVYYCASG WDFDYWGQGTLVTVSSGGGGSGGGGSGGGGSGGGGSDIRMTQSPSSLSASVGDRVTITCR ASQSIRYYLSWYQQKPGKAPKLLIYTASILQNGVPSRFSGSGSGTDFTLTISSLQPEDFA TYYCLQTYTTPDFGPGTKVEIKTTTPAPRPPTPAPTIASQPLSLRPEACRPAAGGAVHTR GLDFACDIYIWAPLAGTCGVLLLSLVITLYCKRGRKKLLYIFKQPFMRPVQTTQEEDGCS CRFPEEEEGGCELRVKFSRSADAPAYKQGQNQLYNELNLGRREEYDVLDKRRGRDPEMGG KPRRKNPQEGLYNELQKDKMAEAYSEIGMKGERRRGKGHDGLYQGLSTATKDTYDALHMQ ALPPR |
| SEQ ID NO: 1533 | M12 (ScFv domain) | QVQLVQSGAEVKKPGASVKVSCKASGYTFTGYYMHWVRQAPGQGLEWMGRINPNSGGTNY AQKFQGRVTMTTDTSTSTAYMELRSLRSDDTAVYYCARTTTSYAFDIWGQGTMVTVSSGG GGSGGGGSGGGGSGGGGSDIQLTQSPSTLSASVGDRVTITCRASQSISTWLAWYQQKPGK APNLLIYKASTLESGVPSRFSGSGSGTEFTLTISSLQPDDFATYYCQQYNTYSPYTFGQG TKLEIK |
| SEQ ID NO: 1534 | M12 >DE12-14RD (M12 DE12-14RD R001-G9126172) | MALPVTALLLPLALLLHAARPQVQLVQSGAEVKKPGASVKVSCKASGYTFTGYYMHWVRQ APGQGLEWMGRINPNSGGTNYAQKFQGRVTMTTDTSTSTAYMELRSLRSDDTAVYYCART TTSYAFDIWGQGTMVTVSSGGGGSGGGGSGGGGSGGGGSDIQLTQSPSTLSASVGDRVTI TCRASQSISTWLAWYQQKPGKAPNLLIYKASTLESGVPSRFSGSGSGTEFTLTISSLQPD DFATYYCQQYNTYSPYTFGQGTKLEIKTTTPAPRPPTPAPTIASQPLSLRPEACRPAAGG AVHTRGLDFACDIYIWAPLAGTCGVLLLSLVITLYCKRGRKKLLYIFKQPFMRPVQTQE EDGCSCRFPEEEEGGCELRVKFSRSADAPAYKQGQNQLYNELNLGRREEYDVLDKRRGRD PEMGGKPRRKNPQEGLYNELQKDKMAEAYSEIGMKGERRRGKGHDGLYQGLSTATKDTYD ALHMQALPPR |

TABLE 34-continued

Mesothelin CAR sequences. Amino acid sequences of human scFvs and CARs that bind to mesothelin (bold underline is the leader sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| SEQ ID NO: 1535 | M13 (ScFv domain) | QVQLVQSGGGLVKPGGSLRLSCEASGFIFSDYYMGWIRQAPGKGLEWVSYIGRSGSSMYY ADSVKGRFTFSRDNAKNSLYLQMNSLRAEDTAVYYCAASPVVAATEDFQHWGQGTLVTVS SGGGGSGGGGSGGGGSGGGGSDIVMTQTPATLSLSPGERATLSCRASQSVTSNYLAWYQQ KPGQAPRLLLFGASTRATGIPDRFSGSGSGTDFTLTINRLEPEDFAMYYCQQYGSAPVTF GQGTKLEIK |
| SEQ ID NO: 1536 | M13 >TE13-19LD (M13 TE13-19LD R002-C3126173) | MALPVTALLLPLALLLHAARPQVQLVQSGGGLVKPGGSLRLSCEASGFIFSDYYMGWIRQ APGKGLEWVSYIGRSGSSMYYADSVKGRFTFSRDNAKNSLYLQMNSLRAEDTAVYYCAAS PVVAATEDFQHWGQGTLVTVSSGGGGSGGGGSGGGGSGGGGSDIVMTQTPATLSLSPGER ATLSCRASQSVTSNYLAWYQQKPGQAPRLLLFGASTRATGIPDRFSGSGSGTDFTLTINR LEPEDFAMYYCQQYGSAPVTFGQGTKLEIKTTTPAPRPPTPAPTIASQPLSRPEACRPA AGGAVHTRGLDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQGLSTATKD TYDALHMQALPPR |
| SEQ ID NO: 1537 | M14 (ScFv domain) | QVQLVQSGAEVRAPGASVKISCKASGFTFRGYYIHWVRQAPGQGLEWMGIINPSGGSRAY AQKFQGRVTMTRDTSTSTVYMELSSLRSDDTAMYYCARTASCGGDCYYLDYWGQGTLVTV SSGGGGSGGGGSGGGGSGGGGSDIQMTQSPPTLSASVGDRVTITCRASENVNIWLAWYQQ KPGKAPKLLIYKSSSLASGVPSRFSGSGSGAEFTLTISSLQPDDFATYYCQQYQSYPLTF GGGTKVDIK |
| SEQ ID NO: 1538 | M14 >BS83-95ID (M14 BS83-95ID R001-E8126174) | MALPVTALLLPLALLLHAARPQVQLVQSGAEVRAPGASVKISCKASGFTERGYYIHWVRQ APGQGLEWMGIINPSGGSRAYAQKFQGRVTMTRDTSTSTVYMELSSLRSDDTAMYYCART ASCGGDCYYLDYWGQGTLVTVSSGGGGSGGGGSGGGGSGGGGSDIQMTQSPPTLSASVGD RVTITCRASENVNIWLAWYQQKPGKAPKLLIYKSSSLASGVPSRFSGSGSGAEFTLTISS LQPDDFATYYCQQYQSYPLTFGGGTKVDIKTTTPAPRPPTPAPTIASQPLSRPEACRPA AGGAVHTRGLDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQGLSTATKD TYDALHMQALPPR |
| SEQ ID NO: 1539 | M15 (ScFv domain) | QVQLVQSGGGLVQPGRSLRLSCAASGFTEDDYAMHWVRQAPGKGLEWVSGISWNSGSIGY ADSVKGRFTISRDNAKNSLYLQMNSLRAEDTAVYYCAKDGSSSWSWGYFDYWGQGTLVTV SSGGGGSGGGGSGGGGSSSELTQDPAVSVALGQTVRTTCQGDALRSYYASWYQQKPGQAP MLVIYGKNNRPSGIPDRFSGSDSGDTASLTITGAQAEDEADYYCNSRDSSGYPVFGTGTK VTVL |
| SEQ ID NO: 1540 | M15 >HS86-94XD (M15 HS86-94XD NT 127553) | MALPVTALLLPLALLLHAARPQVQLVQSGGGLVQPGRSLRLSCAASGFTFDDYAMHWVRQ APGKGLEWVSGISWNSGSIGYADSVKGRFTISRDNAKNSLYLQMNSLRAEDTAVYYCAKD GSSSWSWGYFDYWGQGTLVTVSSGGGGSGGGGSGGGGSSSELTQDPAVSVALGQTVRTTC QGDALRSYYASWYQQKPGQAPMLVIYGKNNRPSGIPDRFSGSDSGDTASLTITGAQAEDE ADYYCNSRDSSGYPVFGTGTKVTVLTTTPAPRPPTPAPTIASQPLSRPEACRPAAGGAV HTRGLDFACDIYIWAPLAGTCGVLLLSLVITLYCKRGRKKLLYIFKQPFMRPVQTTQEED GCSCRFPEEEEGGCELRVKFSRSADAPAYKQGQNQLYNELNLGRREEYDVLDKRRGRDPE MGGKPRRKNPQEGLYNELQKDKMAEAYSEIGMKGERRRGKGHDGLYQGLSTATKDTYDAL HMQALPPR |
| SEQ ID NO: 1541 | M16 (ScFv domain) | EVQLVESGGGLVQPGRSLRLSCAASGFTEDDYAMHWVRQAPGKGLEWVSGISWNSGSTGY ADSVKGRFTISRDNAKNSLYLQMNSLRAEDTALYYCAKDSSSWYGGGSAFDIWGQGTMVT VSSGGGGSGGGGSGGGGSSSELTQEPAVSVALGQTVRITCQGDSLRSYYASWYQQKPGQA PVLVIFGRSRRPSGIPDRFSGSSSGNTASLIITGAQAEDEADYYCNSRDNTANHYVFGTG TKLTVL |
| SEQ ID NO: 1542 | M16 >XS87-99RD (M16 XS87-99RD NT 127554) | MALPVTALLLPLALLLHAARPEVQLVESGGGLVQPGRSLRLSCAASGFTFDDYAMHWVRQ APGKGLEWVSGISWNSGSTGYADSVKGRFTISRDNAKNSLYLQMNSLRAEDTALYYCAKD SSSWYGGGSAFDIWGQGTMVTVSSGGGGSGGGGSGGGGSSSELTQEPAVSVALGQTVRIT CQGDSLRSYYASWYQQKPGQAPVLVIFGRSRRPSGIPDRFSGSSSGNTASLIITGAQAED EADYYCNSRDNTANHYVFGTGTKLTVLTTTPAPRPPTPAPTIASQPLSRPEACRPAAGG AVHTRGLDFACDIYIWAPLAGTCGVLLLSLVITLYCKRGRKKLLYIFKQPFMRPVQTTQE EDGCSCRFPEEEEGGCELRVKFSRSADAPAYKQGQNQLYNELNLGRREEYDVLDKRRGRD PEMGGKPRRKNPQEGLYNELQKDKMAEAYSEIGMKGERRRGKGHDGLYQGLSTATKDTYD ALHMQALPPR |

TABLE 34-continued

Mesothelin CAR sequences. Amino acid sequences of human scFvs and
CARs that bind to mesothelin (bold underline is the leader sequence).
In the case of the scFvs, the remaining amino acids are the heavy
chain variable region and light chain variable regions, with each
of the HC CDRs (HC CDR1, HC CDR2, HC CDR3) and LC CDRs (LC CDR1,
LC CDR2, LCCDR3) underlined. In the case of the CARs, the further
remaining amino acids are the remaining amino acids of the CARs.

| SEQ ID NO: | Description | Amino Acid Sequence |
|---|---|---|
| SEQ ID NO: 1543 | M17 (ScFv domain) | EVQLVESGGGLVQPGRSLRLSCAASGFTEDDYAMHWVRQAPGKGLEWVSGISWNSGSTGY ADSVKGRFTISRDNAKNSLYLQMNSLRAEDTALYYCAKDSSSWYGGGSAFDIWGQGTMVT VSSGGGGSGGGGSGGGGSSSELTQDPAVSVALGQTVRITCQGDSLRSYYASWYQQKPGQA PVLVIYGKNNRPSGIPDRFSGSSSGNTASLTITGAQAEDEADYYCNSRGSSGNHYVFGTG TKVTVL |
| SEQ ID NO: 1544 | M17 >NS89- 94MD (M17 NS89- 94MD NT 127555) | MALPVTALLLPLALLLHAARPEVQLVESGGGLVQPGRSLRLSCAASGFTFDDYAMHWVRQ APGKGLEWVSGISWNSGSTGYADSVKGRFTISRDNAKNSLYLQMNSLRAEDTALYYCAKD SSSWYGGGSAFDIWGQGTMVTVSSGGGGSGGGGSGGGGSSSELTQDPAVSVALGQTVRIT CQGDSLRSYYASWYQQKPGQAPVLVIYGKNNRPSGIPDRFSGSSSGNTASLTITGAQAED EADYYCNSRGSSGNHYVFGTGTKVTVLTTTPAPRPPTPAPTIASQPLSLRPEACRPAAGG AVHTRGLDFACDIYIWAPLAGTCGVLLLSLVITLYCKRGRKKLLYIFKQPFMRPVQTTQE EDGCSCRFPEEEEGGCELRVKFSRSADAPAYKQGQNQLYNELNLGRREEYDVLDKRRGRD PEMGGKPRRKNPQEGLYNELQKDKMAEAYSEIGMKGERRRGKGHDGLYQGLSTATKDTYD ALHMQALPPR |
| SEQ ID NO: 1545 | M18 (ScFv domain) | QVQLVQSGGGLVQPGGSLRLSCAASGFTESSYWMHWVRQAPGKGLVWVSRINSDGSSTSY ADSVKGRFTISRDNAKNTLYLQMNSLRAEDTAVYYCVRTGWVGSYYYYMDVWGKGTTVTV SSGGGGSGGGGSGGGGSGGGGSEIVLTQSPGTLSLSPGERATLSCRASQSVSSNYLAWYQ QKPGQPPRLLIYDVSTRATGIPARFSGGGSGTDFTLTISSLEPEDFAVYYCQQRSNWPPW TFGQGTKVEIK |
| SEQ ID NO: 1546 | M18 >DS90- 09HD (M18 DS90- 09HD R003- A05127556) | MALPVTALLLPLALLLHAARPQVQLVQSGGGLVQPGGSLRLSCAASGFTFSSYWMHWVRQ APGKGLVWVSRINSDGSSTSYADSVKGRFTISRDNAKNTLYLQMNSLRAEDTAVYYCVRT GWVGSYYYYMDVWGKGTTVTVSSGGGGSGGGGSGGGGSGGGGSEIVLTQSPGTLSLSPGE RATLSCRASQSVSSNYLAWYQQKPGQPPRLLIYDVSTRATGIPARFSGGGSGTDFTLTIS SLEPEDFAVYYCQQRSNWPPWTFGQGTKVEIKTTTPAPRPPTPAPTIASQPLSLRPEACR PAAGGAVHTRGLDFACDIYIWAPLAGTCGVLLLSLVITLYCKRGRKKLLYIFKQPFMRPV QTTQEEDGCSCRFPEEEEGGCELRVKFSRSADAPAYKQGQNQLYNELNLGRREEYDVLDK RRGRDPEMGGKPRRKNPQEGLYNELQKDKMAEAYSEIGMKGERRRGKGHDGLYQGLSTAT KDTYDALHMQALPPR |
| SEQ ID NO: 1547 | M19 (ScFv domain) | QVQLVQSGGGVVQPGRSLRLSCAASGFTFSSYGMHWVRQAPGKGLEWVAVISYDGSNKYY ADSVKGRFTISRDNSKNTLYLQMNSLRAEDTAVYYCAKGYSRYYYYGMDVWGQGTTVTVS SGGGGSGGGGSGGGGSGGGGSEIVMTQSPATLSLSPGERAILSCRASQSVYTKYLGWYQQ KPGQAPRLLIYDASTRATGIPDRFSGSGSGTDFTLTINRLEPEDFAVYYCQHYGGSPLIT FGQGTKVDIK |
| SEQ ID NO: 1548 | M19 >TS92- 04BD (M19 TS92- 04BD R003- C06127557) | MALPVTALLLPLALLLHAARPQVQLVQSGGGVVQPGRSLRLSCAASGFTFSSYGMHWVRQ APGKGLEWVAVISYDGSNKYYADSVKGRFTISRDNSKNTLYLQMNSLRAEDTAVYYCAKG YSRYYYYGMDVWGQGTTVTVSSGGGGSGGGGSGGGGSGGGGSEIVMTQSPATLSLSPGER AILSCRASQSVYTKYLGWYQQKPGQAPRLLIYDASTRATGIPDRFSGSGSGTDFTLTINR LEPEDFAVYYCQHYGGSPLITFGQGTKVDIKTTTPAPRPPTPAPTIASQPLSLRPEACRP AAGGAVHTRGLDFACDIYIWAPLAGTCGVLLLSLVITLYCKRGRKKLLYIFKQPFMRPVQ TTQEEDGCSCRFPEEEEGGCELRVKFSRSADAPAYKQGQNQLYNELNLGRREEYDVLDKR RGRDPEMGGKPRRKNPQEGLYNELQKDKMAEAYSEIGMKGERRRGKGHDGLYQGLSTATK DTYDALHMQALPPR |
| SEQ ID NO: 1549 | M20 (ScFv domain) | QVQLVQSGGGLVQPGGSLRLSCAASGFTFSSYAMSWVRQAPGKGLEWVSAISGSGGSTYY ADSVKGRFTISRDNSKNTLYLQMNSLRAEDTAVYYCAKREAAAGHDWYFDLWGRGTLVTV SSGGGGSGGGGSGGGGSGGGGSDIRVTQSPSSLSASVGDRVTITCRASQSISSYLNWYQQ KPGKAPKLLIYAASSLQSGVPSRFSGSGSGTDFTLTISSLQPEDFATYYCQQSYSIPLTF GQGTKVEIK |
| SEQ ID NO: 1550 | M20 (full) >JS93- 08WD (M20 JS93- 08WD R003- E07127558) | MALPVTALLLPLALLLHAARPQVQLVQSGGGLVQPGGSLRLSCAASGFTFSSYAMSWVRQ APGKGLEWVSAISGSGGSTYYADSVKGRFTISRDNSKNTLYLQMNSLRAEDTAVYYCAKR EAAAGHDWYFDLWGRGTLVTVSSGGGGSGGGGSGGGGSGGGGSDIRVTQSPSSLSASVGD RVTITCRASQSISSYLNWYQQKPGKAPKLLIYAASSLQSGVPSRFSGSGSGTDFTLTISS LQPEDFATYYCQQSYSIPLTFGQGTKVEIKTTTPAPRPPTPAPTIASQPLSLRPEACRPA AGGAVHTRGLDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQGLSTATKD TYDALHMQALPPR |

TABLE 34-continued

Mesothelin CAR sequences. Amino acid sequences of human scFvs and
CARs that bind to mesothelin (bold underline is the leader sequence).
In the case of the scFvs, the remaining amino acids are the heavy
chain variable region and light chain variable regions, with each
of the HC CDRs (HC CDR1, HC CDR2, HC CDR3) and LC CDRs (LC CDR1,
LC CDR2, LCCDR3) underlined. In the case of the CARs, the further
remaining amino acids are the remaining amino acids of the CARs.

| SEQ ID NO: | Description | Amino Acid Sequence |
|---|---|---|
| SEQ ID NO: 1551 | M21 (ScFv domain) | QVQLVQSWAEVKKPGASVKVSCKASGYTFTSYYMHWVRQAPGQGLEWMGIINPSGGSTSY AQKFQGRVTMTRDTSTSTVYMELSNLRSEDTAVYYCARSPRVTTGYFDYWGQGTLVTVSS GGGGSGGGGSGGGGSGGGGSDIQLTQSPSTLSASVGDRVTITCRASQSISSWLAWYQQKP GKAPKLLIYKASSLESGVPSRFSGSGSGTEFTLTISSLQPDDFATYYCQQYSSYPLTFGG GTRLEIK |
| SEQ ID NO: 1552 | M21 (full CAR) | MALPVTALLLPLALLLHAARPQVQLVQSWAEVKKPGASVKVSCKASGYTFTSYYMHWVRQ APGQGLEWMGIINPSGGSTSYAQKFQGRVTMTRDTSTSTVYMELSNLRSEDTAVYYCARS PRVTTGYFDYWGQGTLVTVSSGGGGSGGGGSGGGGSGGGGSDIQLTQSPSTLSASVGDRV TITCRASQSISSWLAWYQQKPGKAPKLLIYKASSLESGVPSRFSGSGSGTEFTLTISSLQ PDDFATYYCQQYSSYPLTFGGGTRLEIKTTTPAPRPPTPAPTIASQPLSLRPEACRPA AGGAVHTRGLDFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQGLSTATKD TYDALHMQALPPR |
| SEQ ID NO: 1553 | M22 (ScFv domain) | QVQLVQSGAEVRRPGASVKISCRASGDTSTRHYIHWLRQAPGQGPEWMGVINPTTGPATG SPAYAQMLQGRVTMTRDTSTRTVYMELRSLRFEDTAVYYCARSVVGRSAPYYFDYWGQGT LVTVSSGGGGSGGGGSGGGGSGGGGSDIQMTQSPSSLSASVGDRVTITCRASQGISDYSA WYQQKPGKAPKLLIYAASTLQSGVPSRFSGSGSGTDFTLTISYLQSEDFATYYCQQYYSY PLTFGGGTKVDIK |
| SEQ ID NO: 1554 | M22 (full CAR) | MALPVTALLLPLALLLHAARPQVQLVQSGAEVRRPGASVKISCRASGDTSTRHYIHWLRQ APGQGPEWMGVINPTTGPATGSPAYAQMLQGRVTMTRDTSTRTVYMELRSLRFEDTAVYY CARSVVGRSAPYYFDYWGQGTLVTVSSGGGGSGGGGSGGGGSGGGGSDIQMTQSPSSLSA SVGDRVTITCRASQGISDYSAWYQQKPGKAPKLLIYAASTLQSGVPSRFSGSGSGTDFTL TISYLQSEDFATYYCQQYYSYPLTEGGGTKVDIKTTTPAPRPPTPAPTIASQPLSLRPEA CRPAAGGAVHTRGLDFACDIYIWAPLAGTCGVLLLSLVITLYCKRGRKKLLYIFKQPFMR PVQTTQEEDGCSCREPEEEEGGCELRVKFSRSADAPAYKQGQNQLYNELNLGRREEYDVL DKRRGRDPEMGGKPRRKNPQEGLYNELQKDKMAEAYSEIGMKGERRRGKGHDGLYQGLST ATKDTYDALHMQALPPR |
| SEQ ID NO: 1555 | M23 (ScFv domain) | QVQLQQSGAEVKKPGASVKVSCKASGYTFTNYYMHWVRQAPGQGLEWMGIINPSGGYTTY AQKFQGRLTMTRDTSTSTVYMELSSLRSEDTAVYYCARIRSCGGDCYYFDNWGQGTLVTV SSGGGGSGGGGSGGGGSGGGGSDIQLTQSPSTLSASVGDRVTITCRASENVNIWLAWYQQ KPGKAPKLLIYKSSSLASGVPSRFSGSGSGAEFTLTISSLQPDDFATYYCQQYQSYPLTF GGGTKVDIK |
| SEQ ID NO: 1556 | M23 (full CAR) | MALPVTALLLPLALLLHAARPQVQLQQSGAEVKKPGASVKVSCKASGYTFTNYYMHWVRQ APGQGLEWMGIINPSGGYTTYAQKFQGRLTMTRDTSTSTVYMELSSLRSEDTAVYYCARI RSCGGDCYYFDNWGQGTLVTVSSGGGGSGGGGSGGGGSGGGGSDIQLTQSPSTLSASVGD RVTITCRASENVNIWLAWYQQKPGKAPKLLIYKSSSLASGVPSRFSGSGSGAEFTLTISS LQPDDFATYYCQQYQSYPLTEGGGTKVDIKTTTPAPRPPTPAPTIASQPLSLRPEACRPA AGGAVHTRGLDFACDIYIWAPLAGTCGVLLLSLVITLYCKRGRKKLLYIFKQPFMRPVQT TQEEDGCSCREPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQGLSTATKD TYDALHMQALPPR |
| SEQ ID NO: 1557 | M24 (ScFv domain) | QITLKESGPALVKPTQTLTLTCTFSGFSLSTAGVHVGWIRQPPGKALEWLALISWADDKR YRPSLRSRLDITRVTSKDQVVLSMTNMQPEDTATYYCALQGFDGYEANWGPGTLVTVSSG GGGSGGGGSGGGGSGGGGSDIVMTQSPSSLSASAGDRVTITCRASRGISSALAWYQQKPG KPPKLLIYDASSLESGVPSRFSGSGSGTDFTLTIDSLEPEDFATYYCQQSYSTPWTFGQG TKVDIK |
| SEQ ID NO: 1558 | M24 (full CAR) | MALPVTALLLPLALLLHAARPQITLKESGPALVKPTQTLTLTCTFSGFSLSTAGVHVGWI RQPPGKALEWLALISWADDKRYRPSLRSRLDITRVTSKDQVVLSMTNMQPEDTATYYCAL QGFDGYEANWGPGTLVTVSSGGGGSGGGGSGGGGSGGGGSDIVMTQSPSSLSASAGDRVT ITCRASRGISSALAWYQQKPGKPPKLLIYDASSLESGVPSRFSGSGSGTDFTLTIDSLEP EDFATYYCQQSYSTPWTFGQGTKVDIKTTTPAPRPPTPAPTIASQPLSLRPEACRPA AGGAVHTRGLDFACDIYIWAPLAGTCGVLLLSLVITLYCKRGRKKLLYIFKQPFMRPVQT TQEEDGCSCREPEEEEGGCELRVKFSRSADAPAYKQGQNQLYNELNLGRREEYDVLDKRR GRDPEMGGKPRRKNPQEGLYNELQKDKMAEAYSEIGMKGERRRGKGHDGLYQGLSTATKD TYDALHMQALPPR |
| SEQ ID NO: 1559 | Ss1 (scFv domain) | QVQLQQSGPELEKPGASVKISCKASGYSFTGYTMNWVKQSHGKSLEWIGLITPYNGASS YNQKFRGKATLTVDKSSSTAYMDLLSLTSEDSAVYFCARGGYDGRGFDYWGQGTTVTVS SGGGGSGGGGSGGGGSDIELTQSPAIMSASPGEKVTMTCSASSSVSYMHWYQQKSGTSP KRWIYDTSKLASGVPGRFSGSGSGNSYSLTISSVEAEDDATYYCQQWSGYPLTFGAGTK LEI |

TABLE 34-continued

Mesothelin CAR sequences. Amino acid sequences of human scFvs and CARs that bind to mesothelin (bold underline is the leader sequence). In the case of the scFvs, the remaining amino acids are the heavy chain variable region and light chain variable regions, with each of the HC CDRs (HC CDR1, HC CDR2, HC CDR3) and LC CDRs (LC CDR1, LC CDR2, LCCDR3) underlined. In the case of the CARs, the further remaining amino acids are the remaining amino acids of the CARs.

| SEQ ID NO: | Description | Amino Acid Sequence |
|---|---|---|
| SEQ ID NO: 1560 | Ss1 (full CAR) | MALPVTALLLPLALLLHAARPQVQLQQSGPELEKPGASVKISCKASGYSFTGYTMNWVK QSHGKSLEWIGLITPYNGASSYNQKFRGKATLTVDKSSSTAYMDLLSLTSEDSAVYFCA RGGYDGRGFDYWGQGTTVTVSSGGGGSGGGGSGGGGSDIELTQSPAIMSASPGEKVTMT CSASSSVSYMHWYQQKSGTSPKRWIYDTSKLASGVPGRFSGSGSGNSYSLTISSVEAED DATYYCQQWSGYPLTFGAGTKLEITTTPAPRPPTPAPTIASQPLSLRPEACRPAAGGAV HTRGLDFACDIYIWAPLAGTCGVLLLSLVITLYCKRGRKKLLYIFKQPFMRPVQTTQEE DGCSCRFPEEEEGGCELRVKFSRSADAPA |

BCMA CAR

In other embodiments, the CAR-expressing cells can specifically bind to BCMA, e.g., can include a CAR molecule, or an antigen binding domain according to Table 1 or 16, SEQ ID NO: 271 or SEQ ID NO: 273 of WO2016/014565, incorporated herein by reference. The amino acid and nucleotide sequences encoding the BCMA CAR molecules and antigen binding domains (e.g., including one, two, three VH CDRs; and one, two, three VL CDRs according to Kabat or Chothia), as specified in WO2016/014565, are provided in Tables 15-18 herein.

TABLE 15

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | SEQ ID NO | HCDR2 | SEQ ID NO | HCDR3 | SEQ ID NO |
|---|---|---|---|---|---|---|
| 139109 | NHGMS | 412 | GIVYSGSTYYAASVKG | 431 | HGGESDV | 453 |
| 139103 | NYAMS | 413 | GISRSGENTYYADSVKG | 432 | SPAHYYGGMDV | 454 |
| 139105 | DYAMH | 414 | GISWNSGSIGYADSVKG | 433 | HSFLAY | 455 |
| 139111 | NHGMS | 412 | GIVYSGSTYYAASVKG | 431 | HGGESDV | 453 |
| 139100 | NFGIN | 415 | WINPKNNNTNYAQKFQG | 434 | GPYYYQSYMDV | 456 |
| 139101 | SDAMT | 416 | VISGSGGTTYYADSVKG | 435 | LDSSGYYYARGPRY | 457 |
| 139102 | NYGIT | 417 | WISAYNGNTNYAQKFQG | 436 | GPYYYMDV | 458 |
| 139104 | NHGMS | 412 | GIVYSGSTYYAASVKG | 431 | HGGESDV | 453 |
| 139106 | NHGMS | 412 | GIVYSGSTYYAASVKG | 431 | HGGESDV | 453 |
| 139107 | NHGMS | 412 | GIVYSGSTYYAASVKG | 431 | HGGESDV | 453 |
| 139108 | DYYMS | 418 | YISSSGSTIYYADSVKG | 437 | ESGDGMDV | 459 |

TABLE 15-continued

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | SEQ ID NO | HCDR2 | SEQ ID NO | HCDR3 | SEQ ID NO |
|---|---|---|---|---|---|---|
| 139110 | DYYMS | 418 | YISSSGNTIYYADSVKG | 438 | STMVREDY | 460 |
| 139112 | NHGMS | 412 | GIVYSGSTYYAASVKG | 431 | HGGESDV | 453 |
| 139113 | NHGMS | 412 | GIVYSGSTYYAASVKG | 431 | HGGESDV | 453 |
| 139114 | NHGMS | 412 | GIVYSGSTYYAASVKG | 431 | HGGESDV | 453 |
| 149362 | SSYYY | 419 | SIYYSGSAYYNPWG | 439 | HWQEWPDAFDISLKS | 461 |
| 149363 | TSGMC | 420 | RIDWDEDKFYSTVS | 440 | SGAGGTSATAFSLKTDI | 462 |
| 149364 | SYSMN | 421 | SISSSSSYIYYADSVKG | 441 | TIAAVYAFDI | 463 |
| 149365 | DYYMS | 418 | YISSSGSTIYYADSVKG | 437 | DLRGAFDI | 464 |
| 149366 | SHYIH | 422 | MINPSGGVTAYSQTLQG | 442 | EGSGSGWYFDF | 465 |
| 149367 | SGGYY | 423 | YIYYSGSTYYNPWS | 443 | AGIAARLRGAFSLKSDI | 466 |
| 149368 | SYAIS | 424 | GIIPIFGTANYAQKFQG | 444 | RGGYQLLRWDVGLLRSAFDI | 467 |
| 149369 | SNSAA | 425 | RTYYRSKWYSFWN | 445 | SSPEGLFLYWFYAISLKSDP | 468 |
| BCMA_EBB-C1978-A4 | SYAMS | 426 | AISGSGGSTYYADSVKG | 446 | VEGSGSLDY | 469 |
| BCMA_EBB-C1978-G1 | RYPMS | 427 | GISDSGVSTYYADSAKG | 447 | RAGSEASDI | 470 |
| BCMA_EBB-C1979-C1 | SYAMS | 426 | AISGSGGSTYYADSVKG | 446 | ATYKRELRYYYGMDV | 471 |
| BCMA_EBB-C1978-C7 | SYAMS | 426 | AISGSGGSTYYADSVKG | 446 | ATYKRELRYYYGMDV | 471 |
| BCMA_EBB-C1978-D10 | DYAMH | 414 | GISWNSGSIGYADSVKG | | VGKAVPDV | 472 |
| BCMA_EBB-C1979-C12 | DYAMH | 414 | SINWKGNSLAYGDSVKG | 448 | HQGVAYYNYAMDV | 473 |
| BCMA_EBB-C1980-G4 | SYAMS | 426 | AISGSGGSTYYADSVKG | 446 | VVRDGMDV | 474 |
| BCMA_EBB-C1980-D2 | SYAMS | 426 | AISGSGGSTYYADSVKG | 446 | IPQTGTFDY | 475 |
| BCMA_EBB-C1978-A10 | SYAMS | 426 | AISGSGGSTYYADSVKG | 446 | ANYKRELRYYYGMDV | 476 |
| BCMA_EBB-C1978-D4 | SYAMS | 426 | AISGSGGSTYYADSVKG | 446 | ALVGATGAFDI | 477 |
| BCMA_EBB-C1980-A2 | SYAMS | 426 | AISGSGGSTYYADSVKG | 446 | WFGEGFDP | 478 |
| BCMA_EBB-C1981-C3 | SYAMS | 426 | AISGSGGSTYYADSVKG | 446 | VGYDSSGYYRDYYGMDV | 479 |

Note: For BCMA_EBB-C1978-D10, the HCDR3 SEQ ID NO is 433.

TABLE 15-continued

Heavy Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | HCDR1 | SEQ ID NO | HCDR2 | SEQ ID NO | HCDR3 | SEQ ID NO |
|---|---|---|---|---|---|---|
| BCMA_EBB-C1978-G4 | SYAMS | 426 | AISGSGGSTYYADSVKG | 446 | MGWSSGYLGAFDI | 480 |
| A7D12.2 | NFGMN | 428 | WINTYTGESYFADDFKG | 449 | GEIYYGYDGGFAY | 481 |
| C11D5.3 | DYSIN | 429 | WINTETREPAYAYDFRG | 450 | DYSYAMDY | 482 |
| C12A3.2 | HYSMN | 430 | RINTESGVPIYADDFKG | 451 | DYLYSLDF | 483 |
| C13F12.1 | HYSMN | 430 | RINTETGEPLYADDFKG | 452 | DYLYSCDY | 484 |

TABLE 16

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | SEQ ID NO | LCDR2 | SEQ ID NO | LCDR3 | SEQ ID NO |
|---|---|---|---|---|---|---|
| 139109 | RASQSISSYLN | 237 | AASSLQS | 240 | QQSYSTPYT | 545 |
| 139103 | RASQSISSSFLA | 485 | GASRRAT | 516 | QQYHSSPSWT | 546 |
| 139105 | RSSQSLLHSNGYNYLD | 486 | LGSNRAS | 517 | MQALQTPYT | 547 |
| 139111 | KSSQSLLRNDGKTPLY | 487 | EVSNRFS | 518 | MQNIQFPS | 548 |
| 139100 | RSSQSLLHSNGYNYLN | 488 | LGSKRAS | 519 | MQALQTPYT | 547 |
| 139101 | RASQSISSYLN | 237 | GASTLAS | 520 | QQSYKRAS | 549 |
| 139102 | RSSQSLLYSNGYNYVD | 489 | LGSNRAS | 517 | MQGRQFPYS | 550 |
| 139104 | RASQSVSSNLA | 490 | GASTRAS | 521 | QQYGSSLT | 551 |
| 139106 | RASQSVSSKLA | 491 | GASIRAT | 522 | QQYGSSSWT | 552 |
| 139107 | RASQSVGSTNLA | 492 | DASNRAT | 523 | QQYGSSPPWT | 553 |
| 139108 | RASQSISSYLN | 237 | AASSLQS | 240 | QQSYTLA | 554 |
| 139110 | KSSESLVHNSGKTYLN | 493 | EVSNRDS | 524 | MQGTHWPGT | 555 |
| 139112 | QASEDINKFLN | 494 | DASTLQT | 525 | QQYESLPLT | 556 |
| 139113 | RASQSVGSNLA | 495 | GASTRAT | 526 | QQYNDWLPVT | 557 |
| 139114 | RASQSIGSSSLA | 496 | GASSRAS | 527 | QQYAGSPPFT | 558 |

TABLE 16-continued

Light Chain Variable Domain CDRs according to the Kabat numbering scheme (Kabat et al. (1991), "Sequences of Proteins of Immunological Interest," 5th Ed. Public Health Service, National Institutes of Health, Bethesda, MD)

| Candidate | LCDR1 | SEQ ID NO | LCDR2 | SEQ ID NO | LCDR3 | SEQ ID NO |
|---|---|---|---|---|---|---|
| 149362 | KASQDIDDAMN | 497 | SATSPVP | 528 | LQHDNFPLT | 559 |
| 149363 | RASQDIYNNLA | 498 | AANKSQS | 529 | QHYYRFPYS | 560 |
| 149364 | RSSQSLLHSNGYNYLD | 486 | LGSNRAS | 517 | MQALQTPYT | 547 |
| 149365 | GGNNIGTKSVH | 499 | DDSVRPS | 530 | QVWDSDSEHVV | 561 |
| 149366 | SGDGLSKKYVS | 500 | RDKERPS | 531 | QAWDDTTVV | 562 |
| 149367 | RASQGIRNWLA | 501 | AASNLQS | 532 | QKYNSAPFT | 563 |
| 149368 | GGNNIGSKSVH | 502 | GKNNRPS | 533 | SSRDSSGDHLRV | 564 |
| 149369 | QGDSLGNYYAT | 503 | GTNNRPS | 534 | NSRDSSGHHLL | 565 |
| BCMA_EBB-C1978-A4 | RASQSVSSAYLA | 504 | GASTRAT | 526 | QHYGSSFNGSSLFT | 566 |
| BCMA_EBB-C1978-G1 | RASQSVSNSLA | 505 | DASSRAT | 535 | QQFGTSSGLT | 567 |
| BCMA_EBB-C1979-C1 | RASQSVSSSFLA | 506 | GASSRAT | 536 | QQYHSSPSWT | 546 |
| BCMA_EBB-C1978-C7 | RASQSVSTTFLA | 507 | GSSNRAT | 537 | QQYHSSPSWT | 546 |
| BCMA_EBB-C1978-D10 | RASQSISSYLN | 237 | AASSLQS | 240 | QQSYSTPYS | 568 |
| BCMA_EBB-C1979-C12 | RATQSIGSSFLA | 508 | GASQRAT | 538 | QHYESSPSWT | 569 |
| BCMA_EBB-C1980-G4 | RASQSVSSSYLA | 509 | GASSRAT | 536 | QQYGSPPRFT | 570 |
| BCMA_EBB-C1980-D2 | RASQSVSSSYLA | 509 | GASSRAT | 536 | QHYGSSPSWT | 571 |
| BCMA_EBB-C1978-A10 | RASQRVASNYLA | 510 | GASSRAT | 536 | QHYDSSPSWT | 572 |
| BCMA_EBB-C1978-D4 | RASQSLSSNFLA | 511 | GASNWAT | 539 | QYYGTSPMYT | 573 |
| BCMA_EBB-C1980-A2 | RSSQSLLHSNGYNYLD | 486 | LGSNRAS | 517 | MQALQTPLT | 574 |
| BCMA_EBB-C1981-C3 | RASQSVSSSYLA | 509 | GTSSRAT | 540 | QHYGNSPPKFT | 575 |
| BCMA_EBB-C1978-G4 | RASQSVASSFLA | 512 | GASGRAT | 541 | QHYGGSPRLT | 576 |
| A7D12.2 | RASQDVNTAVS | 513 | SASYRYT | 542 | QQHYSTPWT | 577 |
| C11D5.3 | RASESVSVIGAHLIH | 514 | LASNLET | 543 | LQSRIFPRT | 578 |

TABLE 16-continued

Light Chain Variable Domain CDRs according to the Kabat
numbering scheme (Kabat et al. (1991), "Sequences of
Proteins of Immunological Interest," 5th Ed. Public
Health Service, National Institutes of Health, Bethesda, MD)

| Candidate | LCDR1 | SEQ ID NO | LCDR2 | SEQ ID NO | LCDR3 | SEQ ID NO |
|---|---|---|---|---|---|---|
| C12A3.2 | RASESVTILGSHLIY | 515 | LASNVQT | 544 | LQSRTIPRT | 579 |
| C13F12.1 | RASESVTILGSHLIY | 515 | LASNVQT | 544 | LQSRTIPRT | 579 |

TABLE 17

Amino Acid and Nucleic Acid Sequences of exemplary
anti-BCMA scFv domains and BCMA CAR molecules. The amino acid
sequences variable heavy chain and variable light chain sequences
for each scFv is also provided.

| Name/Description | SEQ ID NO: | Sequence |
|---|---|---|
| 139109 | | |
| 139109-aa ScFv domain | 580 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSSASGGGGSGGRASGGGGSDIQLTQSPSSLSASVGDR VTITCRASQSISSYLNWYQQKPGKAPKLLIYAASSLQSGVPSRFSGSGSG TDFTLTISSLQPEDFATYYCQQSYSTPYTFGQGTKVEIK |
| 139109-nt ScFv domain | 581 | GAAGTGCAATTGGTGGAATCAGGGGGAGGACTTGTGCAGCCTGGAGGATC GCTGAGACTGTCATGTGCCGTGTCCGGCTTTGCCCTGTCCAACCACGGGA TGTCCTGGGTCCGCCGCGCGCCTGGAAAGGGCCTCGAATGGGTGTCGGGT ATTGTGTACAGCGGTAGCACCTACTATGCCGCATCCGTGAAGGGGAGATT CACCATCAGCCGGGACAACTCCAGGAACACTCTGTACCTCCAAATGAATT CGCTGAGGCCAGAGGACACTGCCATCTACTACTGCTCCGCGCATGGCGGA GAGTCCGACGTCTGGGGACAGGGGACCACCGTGACCGTGTCTAGCGCGTC CGGCGGAGGCGGCAGCGGGGGTCGGGCATCAGGGGCGGCGGATCGGACA TCCAGCTCACCCAGTCCCCGAGCTCGCTGTCCGCCTCCGTGGGAGATCGG GTCACCATCACGTGCCGCGCCAGCCAGTCGATTTCCTCCTACCTGAACTG GTACCAACAGAAGCCCGGAAAAGCCCCGAAGCTTCTCATCTACGCCGCCT CGAGCCTGCAGTCAGGAGTGCCCTCACGGTTCTCCGGCTCCGGTTCCGGT ACTGATTTCACCCTGACCATTTCCTCCCTGCAACCGGAGGACTTCGCTAC TTACTACTGCCAGCAGTCGTACTCCACCCCCTACACTTTCGGACAAGGCA CCAAGGTCGAAATCAAG |
| 139109-aa VH | 582 | EVQLVESGGGLVQPGGSLRLSCAVSGFALSNHGMSWVRRAPGKGLEWVSG IVYSGSTYYAASVKGRFTISRDNSRNTLYLQMNSLRPEDTAIYYCSAHGG ESDVWGQGTTVTVSS |
| 139109-aa VL | 583 | DIQLTQSPSSLSASVGDRVTITCRASQSISSYLNWYQQKPGKAPKLLIYA ASSLQSGVPSRFSGSGSGTDFTLTISSLQPEDFATYYCQQSYSTPYTFGQ GTKVEIK |
| 139109-aa Full CAR | 584 | MALPVTALLLPLALLLHAARPEVQLVESGGGLVQPGGSLRLSCAVSGFAL SNHGMSWVRRAPGKGLEWVSGIVYSGSTYYAASVKGRFTISRDNSRNTLY LQMNSLRPEDTAIYYCSAHGGESDVWGQGTTVTVSSASGGGGSGGRASGG GGSDIQLTQSPSSLSASVGDRVTITCRASQSISSYLNWYQQKPGKAPKLL IYAASSLQSGVPSRFSGSGSGTDFTLTISSLQPEDFATYYCQQSYSTPYT FGQGTKVEIKTTTPAPRPPTPAPTIASQPLSLRPEACRPAAGGAVHTRGL DFACDIYIWAPLAGTCGVLLLSLVITLYCKRGRKKLLYIFKQPFMRPVQT TQEEDGCSCRFPEEEEGGCELRVKFSRSADAPAYKQGQNQLYNELNLGRR EEYDVLDKRRGRDPEMGGKPRRKNPQEGLYNELQKDKMAEAYSEIGMKGE RRRGKGHDGLYQGLSTATKDTYDALHMQALPPR |
| 139109-nt Full CAR | 585 | ATGGCCCTCCCTGTCACCGCCCTGCTGCTTCCGCTGGCTCTTCTGCTCCA CGCCGCTCGGCCCGAAGTGCAATTGGTGGAATCAGGGGGAGGACTTGTGC AGCCTGGAGGATCGCTGAGACTGTCATGTGCCGTGTCCGGCTTTGCCCTG TCCAACCACGGGATGTCCTGGGTCCGCCGCGCGCCTGGAAAGGGCCTCGA ATGGGTGTCGGGTATTGTGTACAGCGGTAGCACCTACTATGCCGCATCCG TGAAGGGGAGATTCACCATCAGCCGGGACAACTCCAGGAACACTCTGTAC CTCCAAATGAATTCGCTGAGGCCAGAGGACACTGCCATCTACTACTGCTC CGCGCATGGCGGAGAGTCCGACGTCTGGGGACAGGGGACCACCGTGACCG TGTCTAGCGCGTCCGGCGGAGGCGGCAGCGGGGGTCGGGCATCAGGGGGC |

TABLE 17-continued

Amino Acid and Nucleic Acid Sequences of exemplary
anti-BCMA scFv domains and BCMA CAR molecules. The amino acid
sequences variable heavy chain and variable light chain sequences
for each scFv is also provided.

| Name/Description | SEQ ID NO: | Sequence |
|---|---|---|
| | | GGCGGATCGGACATCCAGCTCACCCAGTCCCCGAGCTCGCTGTCCGCCTC<br>CGTGGGAGATCGGGTCACCATCACGTGCCGCGCCAGCCAGTCGATTTCCT<br>CCTACCTGAACTGGTACCAACAGAAGCCCGGAAAAGCCCCGAAGCTTCTC<br>ATCTACGCCGCCTCGAGCCTGCAGTCAGGAGTGCCCTCACGGTTCTCCGG<br>CTCCGGTTCCGGTACTGATTTCACCCTGACCATTTCCTCCCTGCAACCGG<br>AGGACTTCGCTACTTACTACTGCCAGCAGTCGTACTCCACCCCCTACACT<br>TTCGGACAAGGCACCAAGGTCGAAATCAAGACCACTACCCCAGCACCGAG<br>GCCACCCACCCCGGCTCCTACCATCGCCTCCCAGCCTCTGTCCCTGCGTC<br>CGGAGGCATGTAGACCCGCAGCTGGTGGGGCCGTGCATACCCGGGGTCTT<br>GACTTCGCCTGCGATATCTACATTTGGGCCCCTCTGGCTGGTACTTGCGG<br>GGTCCTGCTGCTTTCACTCGTGATCACTCTTTACTGTAAGCGCGGTCGGA<br>AGAAGCTGCTGTACATCTTTAAGCAACCCTTCATGAGGCCTGTGCAGACT<br>ACTCAAGAGGAGGACGGCTGTTCATGCCGGTTCCCAGAGGAGGAGGAAGG<br>CGGCTGCGAACTGCGCGTGAAATTCAGCCGCAGCGCAGATGCTCCAGCCT<br>ACAAGCAGGGGCAGAACCAGCTCTACAACGAACTCAATCTTGGTCGGAGA<br>GAGGAGTACGACGTGCTGGACAAGCGGAGAGGACGGGACCCAGAAATGGG<br>CGGGAAGCCGCGCAGAAAGAATCCCCAAGAGGGCCTGTACAACGAGCTCC<br>AAAAGGATAAGATGGCAGAAGCCTATAGCGAGATTGGTATGAAAGGGGAA<br>CGCAGAAGAGGCAAAGGCCACGACGGACTGTACCAGGGACTCAGCACCGC<br>CACCAAGGACACCTATGACGCTCTTCACATGCAGGCCCTGCCGCCTCGG |

TABLE 31

Amino Acid and Nucleic Acid Sequences of exemplary anti-BCMA scFv domains and BCMA CAR molecules. The amino acid sequences variable heavy chain and variable light chain sequences for each scFv is also provided.

| Name/Description | SEQ ID NO: |
|---|---|
| 139103 | |
| 139103- aa ScFv domain | 586 |
| 139103- nt ScFv domain | 587 |
| 139103- aa VH | 588 |
| 139103- aa VL | 589 |
| 139103- aa Full CAR | 590 |
| 139103- nt Full CAR | 591 |
| 139105 | |
| 139105- aa ScFv domain | 592 |
| 139105- nt ScFv domain | 593 |
| 139105- aa VH | 594 |
| 139105- aa VL | 595 |
| 139105- aa Full CAR | 596 |
| 139105- nt Full CAR | 597 |
| 139111 | |
| 139111- aa ScFv domain | 598 |
| 139111- nt ScFv domain | 599 |
| 139111- aa VH | 600 |
| 139111- aa VL | 601 |
| 139111- aa Full CAR | 602 |
| 139111- nt Full CAR | 603 |
| 139100 | |
| 139100- aa ScFv domain | 604 |
| 139100- nt ScFv domain | 605 |
| 139100- aa VH | 606 |
| 139100- aa VL | 607 |
| 139100- aa Full CAR | 608 |
| 139100- nt Full CAR | 609 |
| 139101 | |
| 139101- aa ScFv domain | 610 |
| 139101- nt ScFv domain | 611 |
| 139101- aa VH | 612 |
| 139101- aa VL | 613 |
| 139101- aa Full CAR | 614 |
| 139101- nt Full CAR | 615 |
| 139102 | |
| 139102- aa ScFv domain | 616 |
| 139102- nt ScFv domain | 617 |
| 139102- aa VH | 618 |
| 139102- aa VL | 619 |
| 139102- aa Full CAR | 620 |
| 139102- nt Full CAR | 621 |
| 139104 | |
| 139104- aa ScFv domain | 622 |
| 139104- nt ScFv domain | 623 |
| 139104- aa VH | 624 |
| 139104- aa VL | 625 |
| 139104- aa Full CAR | 626 |
| 139104- nt Full CAR | 627 |
| 139106 | |
| 139106- aa ScFv domain | 628 |
| 139106- nt ScFv domain | 629 |
| 139106- aa VH | 630 |
| 139106- aa VL | 631 |
| 139106- aa Full CAR | 632 |
| 139106- nt Full CAR | 633 |
| 139107 | |
| 139107- aa ScFv domain | 634 |
| 139107- nt ScFv domain | 635 |
| 139107- aa VH | 636 |
| 139107- aa VL | 637 |
| 139107- aa Full CAR | 638 |
| 139107- nt Full CAR | 639 |
| 139108 | |
| 139108- aa ScFv domain | 640 |
| 139108- nt ScFv domain | 641 |
| 139108- aa VH | 642 |
| 139108- aa VL | 643 |

TABLE 31-continued

Amino Acid and Nucleic Acid Sequences of exemplary anti-BCMA scFv domains and BCMA CAR molecules. The amino acid sequences variable heavy chain and variable light chain sequences for each scFv is also provided.

| Name/Description | SEQ ID NO: |
| --- | --- |
| 139108- aa Full CAR | 644 |
| 139108- nt Full CAR | 645 |
| 139110 | |
| | |
| 139110- aa ScFv domain | 646 |
| 139110- nt ScFv domain | 647 |
| 139110- aa VH | 648 |
| 139110- aa VL | 649 |
| 139110- aa Full CAR | 650 |
| 139110- nt Full CAR | 651 |
| 139112 | |
| | |
| 139112- aa ScFv domain | 652 |
| 139112- nt ScFv domain | 653 |
| 139112- aa VH | 654 |
| 139112- aa VL | 655 |
| 139112- aa Full CAR | 656 |
| 139112- nt Full CAR | 657 |
| 139113 | |
| | |
| 139113- aa ScFv domain | 658 |
| 139113- nt ScFv domain | 659 |
| 139113- aa VH | 630 |
| 139113- aa VL | 660 |
| 139113- aa Full CAR | 661 |
| 139113- nt Full CAR | 662 |
| 139114 | |
| | |
| 139114- aa ScFv domain | 663 |
| 139114- nt ScFv domain | 664 |
| 139114- aa VH | 582 |
| 139114- aa VL | 665 |
| 139114- aa Full CAR | 666 |
| 139114- nt Full CAR | 667 |
| 149362 | |
| | |
| 149362-aa ScFv domain | 668 |
| 149362-nt ScFv domain | 669 |
| 149362-aa VH | 670 |
| 149362-aa VL | 671 |
| 149362-aa Full CAR | 672 |
| 149362-nt Full CAR | 673 |
| 149363 | |
| | |
| 149363-aa ScFv domain | 674 |
| 149363-nt ScFv domain | 675 |
| 149363-aa VH | 676 |
| 149363-aa VL | 677 |
| 149363-aa Full CAR | 678 |
| 149363-nt Full CAR | 679 |
| 149364 | |
| | |
| 149364-aa ScFv domain | 680 |
| 149364-nt ScFv domain | 681 |
| 149364-aa VH | 682 |
| 149364-aa VL | 683 |
| 149364-aa Full CAR | 684 |
| 149364-nt Full CAR | 685 |
| 149365 | |
| | |
| 149365-aa ScFv domain | 686 |
| 149365-nt ScFv domain | 687 |
| 149365-aa VH | 688 |
| 149365-aa VL | 689 |
| 149365-aa Full CAR | 690 |
| 149365-nt Full CAR | 691 |
| 149366 | |
| | |
| 149366-aa ScFv domain | 692 |
| 149366-nt ScFv domain | 693 |
| 149366-aa VH | 694 |
| 149366-aa VL | 695 |
| 149366-aa Full CAR | 696 |
| 149366-nt Full CAR | 697 |
| 149367 | |
| | |
| 149367-aa ScFv domain | 698 |
| 149367-nt ScFv domain | 699 |
| 149367-aa VH | 700 |
| 149367-aa VL | 701 |
| 149367-aa Full CAR | 702 |
| 149367-nt Full CAR | 703 |
| 149368 | |
| | |
| 149368-aa ScFv domain | 704 |
| 149368-nt ScFv domain | 705 |
| 149368-aa VH | 706 |
| 149368-aa VL | 707 |
| 149368-aa Full CAR | 708 |
| 149368-nt Full CAR | 709 |
| 149369 | |
| | |
| 149369-aa ScFv domain | 710 |
| 149369-nt ScFv domain | 711 |
| 149369-aa VH | 712 |
| 149369-aa VL | 713 |
| 149369-aa Full CAR | 714 |
| 149369-nt Full CAR | 715 |
| BCMA_EBB -C1978 -A4 | |
| | |
| BCMA_EBB-C1978-A4 - aa ScFv domain | 716 |
| BCMA_EBB-C1978-A4 - nt ScFv domain | 717 |
| BCMA_EBB-C1978-A4 - aa VH | 718 |
| BCMA_EBB-C1978-A4 - aa VL | 719 |
| BCMA_EBB-C1978-A4 - aa Full CART | 720 |
| BCMA_EBB-C1978-A4 - nt Full CART | 721 |
| BCMA_EBB-C1978-G1 | |
| | |
| BCMA_EBB-C1978-G1 - aa ScFv domain | 722 |
| BCMA_EBB-C1978-G1 - nt ScFv domain | 723 |
| BCMA_EBB-C1978-G1 - aa VH | 724 |
| BCMA_EBB-C1978-G1 - aa VL | 725 |
| BCMA_EBB-C1978-G1 - aa Full CART | 726 |
| BCMA_EBB-C1978-G1 - nt Full CART | 727 |
| BCMA_EBB-C1979-C1 | |
| | |
| BCMA_EBB-C1979-C1 - aa ScFv domain | 728 |
| BCMA_EBB-C1979-C1 - nt ScFv domain | 729 |
| BCMA_EBB-C1979-C1 - aa VH | 730 |
| BCMA_EBB-C1979-C1 - aa VL | 731 |
| BCMA_EBB-C1979-C1 - aa Full CART | 732 |
| BCMA_EBB-C1979-C1 - nt Full CART | 733 |
| BCMA_EBB-C1978-C7 | |
| | |
| BCMA_EBB-C1978-C7 - aa ScFv domain | 734 |
| BCMA_EBB-C1978-C7 - nt ScFv domain | 735 |
| BCMA_EBB-C1978-C7 - aa VH | 736 |
| BCMA_EBB-C1978-C7 - aa VL | 737 |
| BCMA_EBB-C1978-C7 - aa Full CART | 738 |
| BCMA_EBB-C1978-C7 - nt Full CART | 739 |
| BCMA_EBB-C1978-D10 | |
| | |
| BCMA_EBB-C1978-D10 - aa ScFv domain | 740 |
| BCMA_EBB-C1978-D10- nt ScFv domain | 741 |
| BCMA_EBB-C1978-D10 - aa VH | 742 |
| BCMA_EBB-C1978-D10- aa VL | 743 |
| BCMA_EBB-C1978-D10 - aa Full CART | 744 |
| BCMA_EBB-C1978-D10 - nt Full CART | 745 |
| BCMA_EBB-C1979-C12 | |
| | |
| BCMA_EBB-C1979-C12- aa ScFv domain | 746 |
| BCMA_EBB-C1979-C12 - nt ScFv domain | 747 |
| BCMA_EBB-C1979-C12 - aa VH | 748 |
| BCMA_EBB-C1979-C12 - aa VL | 749 |

TABLE 31-continued

Amino Acid and Nucleic Acid Sequences of exemplary anti-BCMA scFv domains and BCMA CAR molecules. The amino acid sequences variable heavy chain and variable light chain sequences for each scFv is also provided.

| Name/Description | SEQ ID NO: |
|---|---|
| BCMA_EBB-C1979-C12 - aa Full CART | 750 |
| BCMA_EBB-C1979-C12 - nt Full CART | 751 |
| BCMA_EBB-C1980-G4 | |
| BCMA_EBB-C1980-G4- aa ScFv domain | 752 |
| BCMA_EBB-C1980-G4- nt ScFv domain | 753 |
| BCMA_EBB-C1980-G4- aa VH | 754 |
| BCMA_EBB-C1980-G4- aa VL | 755 |
| BCMA_EBB-C1980-G4- aa Full CART | 756 |
| BCMA_EBB-C1980-G4- nt Full CART | 757 |
| BCMA_EBB-C1980-D2 | |
| BCMA_EBB-C1980-D2- aa ScFv domain | 758 |
| BCMA_EBB-C1980-D2- nt ScFv domain | 759 |
| BCMA_EBB-C1980-D2- aa VH | 760 |
| BCMA_EBB-C1980-D2- aa VL | 761 |
| BCMA_EBB-C1980-D2- aa Full CART | 762 |
| BCMA_EBB-C1980-D2- nt Full CART | 763 |
| BCMA_EBB-C1978-A10 | |
| BCMA_EBB-C1978-A10- aa ScFv domain | 764 |
| BCMA_EBB-C1978-A10- nt ScFv domain | 765 |
| BCMA_EBB-C1978-A10- aa VH | 766 |
| BCMA_EBB-C1978-A10- aa VL | 767 |
| BCMA_EBB-C1978-A10- aa Full CART | 768 |
| BCMA_EBB-C1978-A10- nt Full CART | 769 |
| BCMA_EBB-C1978-D4 | |
| BCMA_EBB-C1978-D4- aa ScFv domain | 770 |
| BCMA_EBB-C1978-D4- nt ScFv domain | 771 |
| BCMA_EBB-C1978-D4- aa VH | 772 |
| BCMA_EBB-C1978-D4- aa VL | 773 |
| BCMA_EBB-C1978-D4- aa Full CART | 774 |
| BCMA_EBB-C1978-D4- nt Full CART | 775 |
| BCMA_EBB-C1980-A2 | |
| BCMA_EBB-C1980-A2- aa ScFv domain | 776 |
| BCMA_EBB-C1980-A2- nt ScFv domain | 777 |
| BCMA_EBB-C1980-A2- aa VH | 778 |
| BCMA_EBB-C1980-A2- aa VL | 779 |
| BCMA_EBB-C1980-A2- aa Full CART | 780 |
| BCMA_EBB-C1980-A2- nt Full CART | 781 |
| BCMA_EBB-C1981-C3 | |
| BCMA_EBB-C1981-C3- aa ScFv domain | 782 |
| BCMA_EBB-C1981-C3- nt ScFv domain | 783 |
| BCMA_EBB-C1981-C3- aa VH | 784 |
| BCMA_EBB-C1981-C3- aa VL | 785 |
| BCMA_EBB-C1981-C3- aa Full CART | 786 |
| BCMA_EBB-C1981-C3- nt Full CART | 787 |
| BCMA_EBB-C1978-G4 | |
| BCMA_EBB-C1978-G4- aa ScFv domain | 788 |
| BCMA_EBB-C1978-G4- nt ScFv domain | 789 |
| BCMA_EBB-C1978-G4- aa VH | 790 |
| BCMA_EBB-C1978-G4- aa VL | 791 |
| BCMA_EBB-C1978-G4- aa Full CART | 792 |
| BCMA_EBB-C1978-G4- nt Full CART | 793 |

TABLE 18

Amino acid sequences of exemplary BCMA binding domains

| SEQ ID NO | Description |
|---|---|
| ER26 | |
| SEQ ID NO: 794 | J6M0 VH |
| SEQ ID NO: 795 | J6M0 VL |
| SEQ ID NO: 796 | Anti-BCMA heavy chain of ER26 |
| SEQ ID NO: 797 | Anti-BCMA light chain of ER26 |
| BQ76 | |
| SEQ ID NO: 798 | 17A5 VH |
| SEQ ID NO: 799 | 17A5 VL |
| SEQ ID NO: 800 | Anti-BCMA heavy chain of BQ76 |
| SEQ ID NO: 801 | Anti-BCMA light chain of BQ76 |
| BU76 | |
| SEQ ID NO: 802 | C11D5 VH |
| SEQ ID NO: 803 | C11D5 VL |
| SEQ ID NO: 804 | Anti-BCMA heavy chain of BU76 |
| SEQ ID NO: 805 | Anti-BCMA light chain of BU76 |
| EE11 | |
| SEQ ID NO: 806 | 83A10 VH |
| SEQ ID NO: 807 | 83A10 VL |
| SEQ ID NO: 808 | Anti-BCMA scFv-Fc of EE11 |
| EM90 | |
| SEQ ID NO: 809 | Comment light chain of EM90 |
| SEQ ID NO: 810 | Anti-BCMA heavy chain of EM90 |

Additional exemplary BCMA-targeting sequences that can be used in the anti-BCMA CAR constructs are disclosed in WO 2017/021450, WO 2017/011804, WO 2017/025038, WO 2016/090327, WO 2016/130598, WO 2016/210293, WO 2016/090320, WO 2016/014789, WO 2016/094304, WO 2016/154055, WO 2015/166073, WO 2015/188119, WO 2015/158671, U.S. Pat. Nos. 9,243,058, 8,920,776, 9,273,141, 7,083,785, 9,034,324, US 2007/0049735, US 2015/0284467, US 2015/0051266, US 2015/0344844, US 2016/0131655, US 2016/0297884, US 2016/0297885, US 2017/0051308, US 2017/0051252, US 2017/0051252, WO 2016/020332, WO 2016/087531, WO 2016/079177, WO 2015/172800, WO 2017/008169, U.S. Pat. No. 9,340,621, US 2013/0273055, US 2016/0176973, US 2015/0368351, US 2017/0051068, US 2016/0368988, US 2015/0232557, herein incorporated by reference in their entireties.

In embodiments, additional exemplary BCMA CAR constructs are generated using the VH and VL sequences from PCT Publication WO2012/0163805 (the contents of which are hereby incorporated by reference in its entirety). Exemplary BCMA CAR constructs and their corresponding DNA sequences are shown in Table 17.

CD22 CAR

In other embodiments, the CAR-expressing cells can specifically bind to CD22, e.g., can include a CAR molecule, or an antigen binding domain (e.g., a humanized antigen binding domain) according to WO2016/164731, incorporated herein by reference.

In embodiments, the CAR molecule comprises an antigen binding domain that binds specifically to CD22 (CD22 CAR). In one embodiment, the antigen binding domain targets human CD22. In one embodiment, the antigen binding domain includes a single chain FIT sequence as described herein.

The sequences of human CD22 CAR are provided below. In some embodiments, a human CD22 CAR is CAR22-65.

Human CD22 CAR scFv sequence (VH-(G4S)3-VL)
(SEQ ID NO: 811)
EVQLQQSGPGLVKPSQTLSLTCAISGDSMLSNSDTWNWIRQSPSRGLEWL

GRTYHRSTWYDDYASSVRGRVSINVDTSKNQYSLQLNAVTPEDTGVYYCA

RVRLQDGNSWSDAFDVWGQGTMVTVSSGGGGSGGGGSGGGGSQSALTQPA

SASGSPGQSVTISCTGTSSDVGGYNYVSWYQQHPGKAPKLMIYDVSNRPS

GVSNRFSGSKSGNTASLTISGLQAEDEADYYCSSYTSSSTLYVFGTGTQL

TVL

Human CD22 CAR heavy chain variable region
(SEQ ID NO: 812)
EVQLQQSGPGLVKPSQTLSLTCAISGDSMLSNSDTWNWIRQSPSRGLEWL

GRTYHRSTWYDDYASSVRGRVSINVDTSKNQYSLQLNAVTPEDTGVYYCA

RVRLQDGNSWSDAFDVWGQGTMVTVSS

Human CD22 CAR light chain variable region
(SEQ ID NO: 813)
QSALTQPASASGSPGQSVTISCTGTSSDVGGYNYVSWYQQHPGKAPKLMI

YDVSNRPSGVSNRFSGSKSGNTASLTISGLQAEDEADYYCSSYTSSSTLY

VFGTGTQLTVL

In some embodiments, the CDRs are defined according to the Kabat numbering scheme, the Chothia numbering scheme, or a combination thereof.

Additional anti-CD20 scFv sequences are provided below:

Human CD22 CAR scFv sequence (VH-(G4S)-VL)
(SEQ ID NO: 1447)
EVQLQQSGPGLVKPSQTLSLTCAISGDSMLSNSDTWNWIRQSPSRGLEWL

GRTYHRSTWYDDYASSVRGRVSINVDTSKNQYSLQLNAVTPEDTGVYYCA

RVRLQDGNSWSDAFDVWGQGTMVTVSSGGGGSQSALTQPASASGSPGQSV

TISCTGTSSDVGGYNYVSWYQQHPGKAPKLMIYDVSNRPSGVSNRFSGSK

SGNTASLTISGLQAEDEADYYCSSYTSSSTLYVFGTGTQLTVL

Human CD22 CAR scFv sequence (VL-(G4S)3-VH)
(SEQ ID NO: 1448)
QSALTQPASASGSPGQSVTISCTGTSSDVGGYNYVSWYQQHPGKAPKLMI

YDVSNRPSGVSNRFSGSKSGNTASLTISGLQAEDEADYYCSSYTSSSTLY

VFGTGTQLTVLGGGGSGGGGSGGGGSEVQLQQSGPGLVKPSQTLSLTCAI

TABLE 19

Heavy Chain Variable Domain CDRs of CD22 CAR (CAR22-65)

| Candidate | HCDR1 | SEQ ID NO: | HCDR2 | SEQ ID NO: | HCDR3 | SEQ ID NO: |
|---|---|---|---|---|---|---|
| CAR22-65 Combined | GDSMLSNSDTWN | 814 | RTYHRSTWYDDYASSVRG | 816 | VRLQDGNSWSDAFDV | 817 |
| CAR22-65 Kabat | SNSDTWN | 815 | RTYHRSTWYDDYASSVRG | 816 | VRLQDGNSWSDAFDV | 817 |

TABLE 20

Light Chain Variable Domain CDRs of CD22 CAR (CAR22-65).
The LC CDR sequences in this table have the same sequence under the Kabat or combined definitions.

| Candidate | LCDR1 | SEQ ID NO: | LCDR2 | SEQ ID NO: | LCDR3 | SEQ ID NO: |
|---|---|---|---|---|---|---|
| CAR22-65 Combined | TGTSSDVGGYNYVS | 818 | DVSNRPS | 819 | SSYTSSSTLYV | 820 |

In some embodiments, the antigen binding domain comprises a HC CDR1, a HC CDR2, and a HC CDR3 of any heavy chain binding domain amino acid sequences listed in Table 19. In embodiments, the antigen binding domain further comprises a LC CDR1, a LC CDR2, and a LC CDR3. In embodiments, the antigen binding domain comprises a LC CDR1, a LC CDR2, and a LC CDR3 amino acid sequences listed in Table 20.

In some embodiments, the antigen binding domain comprises one, two or all of LC CDR1, LC CDR2, and LC CDR3 of any light chain binding domain amino acid sequences listed in Table 20, and one, two or all of HC CDR1, HC CDR2, and HC CDR3 of any heavy chain binding domain amino acid sequences listed in Table 19.

-continued

SGDSMLSNSDTWNWIRQSPSRGLEWLGRTYHRSTWYDDYASSVRGRVSIN

VDTSKNQYSLQLNAVTPEDTGVYYCARVRLQDGNSWSDAFDVWGQGTMVT

VSS

Human CD22 CAR scFv sequence (VL-(G4S)-VH)
(SEQ ID NO: 1449)
QSALTQPASASGSPGQSVTISCTGTSSDVGGYNYVSWYQQHPGKAPKLMI

YDVSNRPSGVSNRFSGSKSGNTASLTISGLQAEDEADYYCSSYTSSSTLY

VFGTGTQLTVLGGGGSEVQLQQSGPGLVKPSQTLSLTCAISGDSMLSNSD

TWNWIRQSPSRGLEWLGRTYHRSTWYDDYASSVRGRVSINVDTSKNQYSL

QLNAVTPEDTGVYYCARVRLQDGNSWSDAFDVWGQGTMVTVSS

The order in which the VL and VH domains appear in the scFv can be varied (i.e., VL-VH, or VH-VL orientation), and where any of one, two, three or four copies of the "G4S" (SEQ ID NO: 168) subunit, in which each subunit comprises the sequence GGGGS (SEQ ID NO: 168) (e.g., (G4S)$_3$ (SEQ ID NO: 142) or (G4S)$_4$(SEQ ID NO: 141)), can connect the variable domains to create the entirety of the scFv domain. Alternatively, the CAR construct can include, for example, a linker including the sequence GSTSGSGKPGSGEG-STKG (SEQ ID NO: 821). Alternatively, the CAR construct can include, for example, a linker including the sequence LAEAAAK (SEQ ID NO: 822). In an embodiment, the CAR construct does not include a linker between the VL and VH domains.

These clones all contained a Q/K residue change in the signal domain of the co-stimulatory domain derived from CD3zeta chain.

In some embodiments, the CAR molecule described herein is a bispecific CAR molecule. In one embodiment, the bispecific CAR molecule comprises a first binding specificity to CD19, e.g., a VL1-VH1 binding specificity to CD19, and a second binding specificity to CD22, e.g., a VL2-VH2 or VH2-VL1 binding specificity to CD22. In one embodiment, the first and second binding specificity are in a contiguous polypeptide chain, e.g., a single chain. In some embodiments, the first and second binding specificities, optionally, comprise a linker as described herein. In some embodiments, the bispecific CAR molecule comprises a CD19-binding domain comprising an amino acid sequence disclosed in Table 5 and Table 30.

In one embodiment, the bispecific CAR molecule comprises a first binding specificity to CD22, e.g., a VL2-VH2 or VH2-VL1 binding specificity to CD22, and a second binding specificity to CD19, e.g., a VL1-VH1 binding specificity to CD19. In one embodiment, the first and second binding specificity are in a contiguous polypeptide chain, e.g., a single chain. In some embodiments, the first and second binding specificities, optionally, comprise a linker as described herein.

In some embodiments, the linker is a (Gly$_4$-Ser)$_n$ linker, wherein n is 1, 2, 3, 4, 5, or 6. In some embodiments, the linker is (Gly$_4$-Ser)$_n$, wherein n=1 (SEQ ID NO: 168), e.g., the linker has the amino acid sequence Gly$_4$-Ser (SEQ ID NO: 168). In some embodiments, the linker is (Gly$_4$-Ser)$_n$, wherein n=3 (SEQ ID NO: 142). In some embodiments, the linker is (Gly$_4$-Ser)$_n$, wherein n=4 (SEQ ID NO: 141). In some embodiments, the linker comprises, e.g., consists of, the amino acid sequence: LAEAAAK (SEQ ID NO: 822).

CD20 CAR

In some embodiments, the CAR-expressing cell described herein is a CD20 CAR-expressing cell (e.g., a cell expressing a CAR that binds to human CD20). In some embodiments, the CD20 CAR-expressing cell includes an antigen binding domain according to WO2016/164731 and PCT/US2017/055627, incorporated herein by reference. Exemplary CD20-binding sequences or CD20 CAR sequences are disclosed in, e.g., Tables 1-5 of PCT/US2017/055627, incorporated herein by reference. In some embodiments, the CD20-binding sequences or CD20 CAR comprises a CDR, variable region, scFv, or full-length sequence of a CD20 CAR disclosed in PCT/US2017/055627 or WO2016/164731, incorporated herein by reference. Exemplary anti-CD20 CAR sequences may comprise a CDR, a variable region, an scFv, or a full-length CAR sequence of a sequence disclosed in Table 32 (or a sequence at least about 85%, 90%, 95%, 99% or more identical thereto, and/or having one, two, three or more substitutions, insertions, deletions, or modifications).

TABLE 32

CD20 CAR sequences.

| SEQ ID NO | Ab region |
|---|---|
| CD20-C3H2 | |
| SEQ ID NO: 838 (Kabat) | HCDR1 |
| SEQ ID NO: 839 (Kabat) | HCDR2 |
| SEQ ID NO: 840 (Kabat) | HCDR3 |
| SEQ ID NO: 841 (Chothia) | HCDR1 |
| SEQ ID NO: 842 (Chothia) | HCDR2 |
| SEQ ID NO: 843 (Chothia) | HCDR3 |
| SEQ ID NO: 844 (IMGT) | HCDR1 |
| SEQ ID NO: 845 (IMGT) | HCDR2 |
| SEQ ID NO: 846 (IMGT) | HCDR3 |
| SEQ ID NO: 847 (Combined Chothia and Kabat) | HCDR1 |
| SEQ ID NO: 848 (Combined Chothia and Kabat) | HCDR2 |
| SEQ ID NO: 849 (Combined Chothia and Kabat) | HCDR3 |
| SEQ ID NO: 850 | VH |
| SEQ ID NO: 851 | DNA VH |
| SEQ ID NO: 852 (Kabat) | LCDR1 |
| SEQ ID NO: 853 (Kabat) | LCDR2 |
| SEQ ID NO: 854 (Kabat) | LCDR3 |
| SEQ ID NO: 855 (Chothia) | LCDR1 |
| SEQ ID NO: 856 (Chothia) | LCDR2 |
| SEQ ID NO: 857 (Chothia) | LCDR3 |
| SEQ ID NO: 858 (IMGT) | LCDR1 |
| SEQ ID NO: 859 (IMGT) | LCDR2 |
| SEQ ID NO: 860 (IMGT) | LCDR3 |
| SEQ ID NO: 861 (Combined Chothia and Kabat) | LCDR1 |
| SEQ ID NO: 862 (Combined Chothia and Kabat) | LCDR2 |
| SEQ ID NO: 863 (Combined Chothia and Kabat) | LCDR3 |
| SEQ ID NO: 864 | VL |
| SEQ ID NO: 865 | DNA VL |
| SEQ ID NO: 866 | Linker |
| SEQ ID NO: 867 | scFv (VH-linker-VL) |
| SEQ ID NO: 868 | DNA scFv (VH-linker-VL) |

TABLE 32-continued

CD20 CAR sequences.

| SEQ ID NO | Ab region |
|---|---|
| SEQ ID NO: 869 | Full CAR amino acid sequence |
| SEQ ID NO: 870 | Full CAR nucleic acid sequence |
| CD20-C5H1 | |
| SEQ ID NO: 871 (Rabat) | HCDR1 |
| SEQ ID NO: 872 (Rabat) | HCDR2 |
| SEQ ID NO: 873 (Rabat) | HCDR3 |
| SEQ ID NO: 874 (Chothia) | HCDR1 |
| SEQ ID NO: 875 (Chothia) | HCDR2 |
| SEQ ID NO: 876 (Chothia) | HCDR3 |
| SEQ ID NO: 877 (IMGT) | HCDR1 |
| SEQ ID NO: 878 (IMGT) | HCDR2 |
| SEQ ID NO: 879 (IMGT) | HCDR3 |
| SEQ ID NO: 880 (Combined Chothia and Rabat) | HCDR1 |
| SEQ ID NO: 881 (Combined Chothia and Rabat) | HCDR2 |
| SEQ ID NO: 882 (Combined Chothia and Kabat) | HCDR3 |
| SEQ ID NO: 883 | VH |
| SEQ ID NO: 884 | DNA VH |
| SEQ ID NO: 885 (Kabat) | LCDR1 |
| SEQ ID NO: 886 (Kabat) | LCDR2 |
| SEQ ID NO: 887 (Kabat) | LCDR3 |
| SEQ ID NO: 888 (Chothia) | LCDR1 |
| SEQ ID NO: 889 (Chothia) | LCDR2 |
| SEQ ID NO: 890 (Chothia) | LCDR3 |
| SEQ ID NO: 891 (IMGT) | LCDR1 |
| SEQ ID NO: 892 (IMGT) | LCDR2 |
| SEQ ID NO: 893 (IMGT) | LCDR3 |
| SEQ ID NO: 894 (Combined Chothia and Kabat) | LCDR1 |
| SEQ ID NO: 895 (Combined Chothia and Kabat) | LCDR2 |
| SEQ ID NO: 896 (Combined Chothia and Kabat) | LCDR3 |
| SEQ ID NO: 897 | VL |
| SEQ ID NO: 898 | DNA VL |
| SEQ ID NO: 899 | Linker |
| SEQ ID NO: 900 | scFv (VH-linker-VL) |
| SEQ ID NO: 901 | DNA scFv (VH-linker-VL) |
| SEQ ID NO: 902 | Full CAR amino acid sequence |
| SEQ ID NO: 903 | Full CAR nucleic acid sequence |
| CD20-C2H1 | |
| SEQ ID NO: 904 (Kabat) | HCDR1 |
| SEQ ID NO: 905 (Kabat) | HCDR2 |
| SEQ ID NO: 906 (Kabat) | HCDR3 |
| SEQ ID NO: 907 (Chothia) | HCDR1 |
| SEQ ID NO: 908 (Chothia) | HCDR2 |
| SEQ ID NO: 909 (Chothia) | HCDR3 |
| SEQ ID NO: 910 (IMGT) | HCDR1 |
| SEQ ID NO: 911 (IMGT) | HCDR2 |
| SEQ ID NO: 912 (IMGT) | HCDR3 |
| SEQ ID NO: 913 (Combined Chothia and Kabat) | HCDR1 |
| SEQ ID NO: 914 (Combined Chothia and Kabat) | HCDR2 |
| SEQ ID NO: 915 (Combined Chothia and Kabat) | HCDR3 |
| SEQ ID NO: 916 | VH |
| SEQ ID NO: 917 | DNA VH |
| SEQ ID NO: 918 (Kabat) | LCDR1 |
| SEQ ID NO: 919 (Kabat) | LCDR2 |
| SEQ ID NO: 920 (Kabat) | LCDR3 |
| SEQ ID NO: 921 (Chothia) | LCDR1 |
| SEQ ID NO: 922 (Chothia) | LCDR2 |
| SEQ ID NO: 923 (Chothia) | LCDR3 |
| SEQ ID NO: 924 (IMGT) | LCDR1 |
| SEQ ID NO: 925 (IMGT) | LCDR2 |
| SEQ ID NO: 926 (IMGT) | LCDR3 |
| SEQ ID NO: 927 (Combined Chothia and Kabat) | LCDR1 |
| SEQ ID NO: 928 (Combined Chothia and Kabat) | LCDR2 |
| SEQ ID NO: 929 (Combined Chothia and Kabat) | LCDR3 |
| SEQ ID NO: 930 | VL |
| SEQ ID NO: 931 | DNA VL |
| SEQ ID NO: 932 | Linker |
| SEQ ID NO: 933 | scFv (VH-linker-VL) |
| SEQ ID NO: 934 | DNA scFv (VH-linker-VL) |
| SEQ ID NO: 935 | Full CAR amino acid sequence |
| SEQ ID NO: 936 | Full CAR nucleic acid sequence |
| CD20-C2H2 | |
| SEQ ID NO: 937 (Rabat) | HCDR1 |
| SEQ ID NO: 938 (Rabat) | HCDR2 |

TABLE 32-continued

CD20 CAR sequences.

| SEQ ID NO | Ab region |
|---|---|
| SEQ ID NO: 939 (Kabat) | HCDR3 |
| SEQ ID NO: 940 (Chothia) | HCDR1 |
| SEQ ID NO: 941 (Chothia) | HCDR2 |
| SEQ ID NO: 942 (Chothia) | HCDR3 |
| SEQ ID NO: 943 (IMGT) | HCDR1 |
| SEQ ID NO: 944 (IMGT) | HCDR2 |
| SEQ ID NO: 945 (IMGT) | HCDR3 |
| SEQ ID NO: 946 (Combined Chothia and Kabat) | HCDR1 |
| SEQ ID NO: 947 (Combined Chothia and Kabat) | HCDR2 |
| SEQ ID NO: 948 (Combined Chothia and Kabat) | HCDR3 |
| SEQ ID NO: 949 | VH |
| SEQ ID NO: 950 | DNA VH |
| SEQ ID NO: 951 (Kabat) | LCDR1 |
| SEQ ID NO: 952 (Kabat) | LCDR2 |
| SEQ ID NO: 953 (Kabat) | LCDR3 |
| SEQ ID NO: 954 (Chothia) | LCDR1 |
| SEQ ID NO: 955 (Chothia) | LCDR2 |
| SEQ ID NO: 956 (Chothia) | LCDR3 |
| SEQ ID NO: 957 (IMGT) | LCDR1 |
| SEQ ID NO: 958 (IMGT) | LCDR2 |
| SEQ ID NO: 959 (IMGT) | LCDR3 |
| SEQ ID NO: 960 (Combined Chothia and Kabat) | LCDR1 |
| SEQ ID NO: 961 (Combined Chothia and Kabat) | LCDR2 |
| SEQ ID NO: 962 (Combined Chothia and Kabat) | LCDR3 |
| SEQ ID NO: 963 | VL |
| SEQ ID NO: 964 | DNA VL |
| SEQ ID NO: 965 | Linker |
| SEQ ID NO: 966 | scFv (VH-linker-VL) |
| SEQ ID NO: 967 | DNA scFv (VH-linker-VL) |
| SEQ ID NO: 968 | Full CAR amino acid sequence |
| SEQ ID NO: 969 | Full CAR nucleic acid sequence |
| CD20-C2H3 | |
| SEQ ID NO: 970 (Kabat) | HCDR1 |
| SEQ ID NO: 971 (Kabat) | HCDR2 |
| SEQ ID NO: 972 (Kabat) | HCDR3 |
| SEQ ID NO: 973 (Chothia) | HCDR1 |
| SEQ ID NO: 974 (Chothia) | HCDR2 |
| SEQ ID NO: 975 (Chothia) | HCDR3 |
| SEQ ID NO: 976 (IMGT) | HCDR1 |
| SEQ ID NO: 977 (IMGT) | HCDR2 |
| SEQ ID NO: 978 (IMGT) | HCDR3 |
| SEQ ID NO: 979 (Combined Chothia and Kabat) | HCDR1 |
| SEQ ID NO: 980 (Combined Chothia and Kabat) | HCDR2 |
| SEQ ID NO: 981 (Combined Chothia and Kabat) | HCDR3 |
| SEQ ID NO: 982 | VH |
| SEQ ID NO: 983 | DNA VH |
| SEQ ID NO: 984 (Kabat) | LCDR1 |
| SEQ ID NO: 985 (Kabat) | LCDR2 |
| SEQ ID NO: 986 (Kabat) | LCDR3 |
| SEQ ID NO: 987 (Chothia) | LCDR1 |
| SEQ ID NO: 988 (Chothia) | LCDR2 |
| SEQ ID NO: 989 (Chothia) | LCDR3 |
| SEQ ID NO: 990 (IMGT) | LCDR1 |
| SEQ ID NO: 991 (IMGT) | LCDR2 |
| SEQ ID NO: 992 (IMGT) | LCDR3 |
| SEQ ID NO: 993 (Combined Chothia and Kabat) | LCDR1 |
| SEQ ID NO: 994 (Combined Chothia and Kabat) | LCDR2 |
| SEQ ID NO: 995 (Combined Chothia and Kabat) | LCDR3 |
| SEQ ID NO: 996 | VL |
| SEQ ID NO: 997 | DNA VL |
| SEQ ID NO: 998 | Linker |
| SEQ ID NO: 999 | scFv (VH-linker-VL) |
| SEQ ID NO: 1000 | DNA scFv (VH-linker-VL) |
| SEQ ID NO: 1001 | Full CAR amino acid sequence |
| SEQ ID NO: 1002 | Full CAR nucleic acid sequence |
| CD20-C2H4 | |
| SEQ ID NO: 1003 (Kabat) | HCDR1 |
| SEQ ID NO: 1004 (Kabat) | HCDR2 |
| SEQ ID NO: 1005 (Kabat) | HCDR3 |
| SEQ ID NO: 1006 (Chothia) | HCDR1 |
| SEQ ID NO: 1007 (Chothia) | HCDR2 |
| SEQ ID NO: 1008 (Chothia) | HCDR3 |
| SEQ ID NO: 1009 (IMGT) | HCDR1 |
| SEQ ID NO: 1010 (IMGT) | HCDR2 |

TABLE 32-continued

CD20 CAR sequences.

| SEQ ID NO | Ab region |
|---|---|
| SEQ ID NO: 1011 (IMGT) | HCDR3 |
| SEQ ID NO: 1012 (Combined Chothia and Rabat) | HCDR1 |
| SEQ ID NO: 1013 (Combined Chothia and Rabat) | HCDR2 |
| SEQ ID NO: 1014 (Combined Chothia and Rabat) | HCDR3 |
| SEQ ID NO: 1015 | VH |
| SEQ ID NO: 1016 | DNA VH |
| SEQ ID NO: 1017 (Rabat) | LCDR1 |
| SEQ ID NO: 1018 (Rabat) | LCDR2 |
| SEQ ID NO: 1019 (Rabat) | LCDR3 |
| SEQ ID NO: 1020 (Chothia) | LCDR1 |
| SEQ ID NO: 1021 (Chothia) | LCDR2 |
| SEQ ID NO: 1022 (Chothia) | LCDR3 |
| SEQ ID NO: 1023 (IMGT) | LCDR1 |
| SEQ ID NO: 1024 (IMGT) | LCDR2 |
| SEQ ID NO: 1025 (IMGT) | LCDR3 |
| SEQ ID NO: 1026 (Combined Chothia and Kabat) | LCDR1 |
| SEQ ID NO: 1027 (Combined Chothia and Kabat) | LCDR2 |
| SEQ ID NO: 1028 (Combined Chothia and Kabat) | LCDR3 |
| SEQ ID NO: 1029 | VL |
| SEQ ID NO: 1030 | DNA VL |
| SEQ ID NO: 1031 | Linker |
| SEQ ID NO: 1032 | scFv (VH-linker-VL) |
| SEQ ID NO: 1033 | DNA scFv (VH-linker-VL) |
| SEQ ID NO: 1034 | Full CAR amino acid sequence |
| SEQ ID NO: 1035 | Full CAR nucleic acid sequence |
| CD20-C3H1 | |
| SEQ ID NO: 1036 (Kabat) | HCDR1 |
| SEQ ID NO: 1037 (Kabat) | HCDR2 |
| SEQ ID NO: 1038 (Kabat) | HCDR3 |
| SEQ ID NO: 1039 (Chothia) | HCDR1 |
| SEQ ID NO: 1040 (Chothia) | HCDR2 |
| SEQ ID NO: 1041 (Chothia) | HCDR3 |
| SEQ ID NO: 1042 (IMGT) | HCDR1 |
| SEQ ID NO: 1043 (IMGT) | HCDR2 |
| SEQ ID NO: 1044 (IMGT) | HCDR3 |
| SEQ ID NO: 1045 (Combined Chothia and Kabat) | HCDR1 |
| SEQ ID NO: 1046 (Combined Chothia and Kabat) | HCDR2 |
| SEQ ID NO: 1047 (Combined Chothia and Kabat) | HCDR3 |
| SEQ ID NO: 1048 | VH |
| SEQ ID NO: 1049 | DNA VH |
| SEQ ID NO: 1050 (Kabat) | LCDR1 |
| SEQ ID NO: 1051 (Kabat) | LCDR2 |
| SEQ ID NO: 1052 (Kabat) | LCDR3 |
| SEQ ID NO: 1053 (Chothia) | LCDR1 |
| SEQ ID NO: 1054 (Chothia) | LCDR2 |
| SEQ ID NO: 1055 (Chothia) | LCDR3 |
| SEQ ID NO: 1056 (IMGT) | LCDR1 |
| SEQ ID NO: 1057 (IMGT) | LCDR2 |
| SEQ ID NO: 1058 (IMGT) | LCDR3 |
| SEQ ID NO: 1059 (Combined Chothia and Kabat) | LCDR1 |
| SEQ ID NO: 1060 (Combined Chothia and Kabat) | LCDR2 |
| SEQ ID NO: 1061 (Combined Chothia and Kabat) | LCDR3 |
| SEQ ID NO: 1062 | VL |
| SEQ ID NO: 1063 | DNA VL |
| SEQ ID NO: 1064 | Linker |
| SEQ ID NO: 1065 | scFv (VH-linker-VL) |
| SEQ ID NO: 1066 | DNA scFv (VH-linker-VL) |
| SEQ ID NO: 1067 | Full CAR amino acid sequence |
| SEQ ID NO: 1068 | Full CAR nucleic acid sequence |
| CD20-C3H3 | |
| SEQ ID NO: 1069 (Kabat) | HCDR1 |
| SEQ ID NO: 1070 (Kabat) | HCDR2 |
| SEQ ID NO: 1071 (Kabat) | HCDR3 |
| SEQ ID NO: 1072 (Chothia) | HCDR1 |
| SEQ ID NO: 1073 (Chothia) | HCDR2 |
| SEQ ID NO: 1074 (Chothia) | HCDR3 |
| SEQ ID NO: 1075 (IMGT) | HCDR1 |
| SEQ ID NO: 1076 (IMGT) | HCDR2 |
| SEQ ID NO: 1077 (IMGT) | HCDR3 |
| SEQ ID NO: 1078 | VH |
| SEQ ID NO: 1079 | DNA VH |
| SEQ ID NO: 1080 (Kabat) | LCDR1 |
| SEQ ID NO: 1081 (Kabat) | LCDR2 |
| SEQ ID NO: 1082 (Kabat) | LCDR3 |

TABLE 32-continued

CD20 CAR sequences.

| SEQ ID NO | Ab region |
| --- | --- |
| SEQ ID NO: 1083 (Chothia) | LCDR1 |
| SEQ ID NO: 1084 (Chothia) | LCDR2 |
| SEQ ID NO: 1085 (Chothia) | LCDR3 |
| SEQ ID NO: 1086 (IMGT) | LCDR1 |
| SEQ ID NO: 1087 (IMGT) | LCDR2 |
| SEQ ID NO: 1088 (IMGT) | LCDR3 |
| SEQ ID NO: 1089 (Combined Chothia and Kabat) | LCDR1 |
| SEQ ID NO: 1090 (Combined Chothia and Kabat) | LCDR2 |
| SEQ ID NO: 1091 (Combined Chothia and Kabat) | LCDR3 |
| SEQ ID NO: 1092 | VL |
| SEQ ID NO: 1093 | DNA VL |
| SEQ ID NO: 1094 | Linker |
| SEQ ID NO: 1095 | scFv (VH-linker-VL) |
| SEQ ID NO: 1096 | DNA scFv (VH-linker-VL) |
| SEQ ID NO: 1097 | Full CAR amino acid sequence |
| SEQ ID NO: 1098 | Full CAR nucleic acid sequence |
| CD20-C3H4 | |
| SEQ ID NO: 1099 (Kabat) | HCDR1 |
| SEQ ID NO: 1100 (Kabat) | HCDR2 |
| SEQ ID NO: 1101 (Kabat) | HCDR3 |
| SEQ ID NO: 1102 (Chothia) | HCDR1 |
| SEQ ID NO: 1103 (Chothia) | HCDR2 |
| SEQ ID NO: 1104 (Chothia) | HCDR3 |
| SEQ ID NO: 1105 (IMGT) | HCDR1 |
| SEQ ID NO: 1106 (IMGT) | HCDR2 |
| SEQ ID NO: 1107 (IMGT) | HCDR3 |
| SEQ ID NO: 1108 (Combined Chothia and Kabat) | HCDR1 |
| SEQ ID NO: 1109 (Combined Chothia and Kabat) | HCDR2 |
| SEQ ID NO: 1110 (Combined Chothia and Kabat) | HCDR3 |
| SEQ ID NO: 1111 | VH |
| SEQ ID NO: 1112 | DNA VH |
| SEQ ID NO: 1113 (Kabat) | LCDR1 |
| SEQ ID NO: 1114 (Kabat) | LCDR2 |
| SEQ ID NO: 1115 (Kabat) | LCDR3 |
| SEQ ID NO: 1116 (Chothia) | LCDR1 |
| SEQ ID NO: 1117 (Chothia) | LCDR2 |
| SEQ ID NO: 1118 (Chothia) | LCDR3 |
| SEQ ID NO: 1119 (IMGT) | LCDR1 |
| SEQ ID NO: 1120 (IMGT) | LCDR2 |
| SEQ ID NO: 1121 (IMGT) | LCDR3 |
| SEQ ID NO: 1122 (Combined Chothia and Rabat) | LCDR1 |
| SEQ ID NO: 1123 (Combined Chothia and Rabat) | LCDR2 |
| SEQ ID NO: 1124 (Combined Chothia and Rabat) | LCDR3 |
| SEQ ID NO: 1125 | VL |
| SEQ ID NO: 1126 | DNA VL |
| SEQ ID NO: 1127 | Linker |
| SEQ ID NO: 1128 | scFv (VH-linker-VL) |
| SEQ ID NO: 1129 | DNA scFv (VH-linker-VL) |
| SEQ ID NO: 1130 | Full CAR amino acid sequence |
| SEQ ID NO: 1131 | Full CAR nucleic acid sequence |
| CD20-C5H2 | |
| SEQ ID NO: 1132 (Rabat) | HCDR1 |
| SEQ ID NO: 1133 (Rabat) | HCDR2 |
| SEQ ID NO: 1134 (Rabat) | HCDR3 |
| SEQ ID NO: 1135 (Chothia) | HCDR1 |
| SEQ ID NO: 1136 (Chothia) | HCDR2 |
| SEQ ID NO: 1137 (Chothia) | HCDR3 |
| SEQ ID NO: 1138 (IMGT) | HCDR1 |
| SEQ ID NO: 1139 (IMGT) | HCDR2 |
| SEQ ID NO: 1140 (IMGT) | HCDR3 |
| SEQ ID NO: 1141 (Combined Chothia and Rabat) | HCDR1 |
| SEQ ID NO: 1142 (Combined Chothia and Rabat) | HCDR2 |
| SEQ ID NO: 1143 (Combined Chothia and Rabat) | HCDR3 |
| SEQ ID NO: 1144 | VH |
| SEQ ID NO: 1145 | DNA VH |
| SEQ ID NO: 1146 (Rabat) | LCDR1 |
| SEQ ID NO: 1147 (Rabat) | LCDR2 |
| SEQ ID NO: 1148 (Rabat) | LCDR3 |
| SEQ ID NO: 1149 (Chothia) | LCDR1 |
| SEQ ID NO: 1150 (Chothia) | LCDR2 |
| SEQ ID NO: 1151 (Chothia) | LCDR3 |
| SEQ ID NO: 1152 (IMGT) | LCDR1 |
| SEQ ID NO: 1153 (IMGT) | LCDR2 |
| SEQ ID NO: 1154 (IMGT) | LCDR3 |

TABLE 32-continued

CD20 CAR sequences.

| SEQ ID NO | Ab region |
|---|---|
| SEQ ID NO: 1155 (Combined Chothia and Rabat) | LCDR1 |
| SEQ ID NO: 1156 (Combined Chothia and Rabat) | LCDR2 |
| SEQ ID NO: 1157 (Combined Chothia and Rabat) | LCDR3 |
| SEQ ID NO: 1158 | VL |
| SEQ ID NO: 1159 | DNA VL |
| SEQ ID NO: 1160 | Linker |
| SEQ ID NO: 1161 | scFv (VH-linker-VL) |
| SEQ ID NO: 1162 | DNA scFv (VH-linker-VL) |
| SEQ ID NO: 1163 | Full CAR amino acid sequence |
| SEQ ID NO: 1164 | Full CAR nucleic acid sequence |
| CD20-C5H3 | |
| SEQ ID NO: 1165 (Rabat) | HCDR1 |
| SEQ ID NO: 1166 (Rabat) | HCDR2 |
| SEQ ID NO: 1167 (Rabat) | HCDR3 |
| SEQ ID NO: 1168 (Chothia) | HCDR1 |
| SEQ ID NO: 1169 (Chothia) | HCDR2 |
| SEQ ID NO: 1170 (Chothia) | HCDR3 |
| SEQ ID NO: 1171 (IMGT) | HCDR1 |
| SEQ ID NO: 1172 (IMGT) | HCDR2 |
| SEQ ID NO: 1173 (IMGT) | HCDR3 |
| SEQ ID NO: 1174 (Combined Chothia and Rabat) | HCDR1 |
| SEQ ID NO: 1175 (Combined Chothia and Rabat) | HCDR2 |
| SEQ ID NO: 1176 (Combined Chothia and Rabat) | HCDR3 |
| SEQ ID NO: 1177 | VH |
| SEQ ID NO: 1178 | DNA VH |
| SEQ ID NO: 1179 (Rabat) | LCDR1 |
| SEQ ID NO: 1180 (Rabat) | LCDR2 |
| SEQ ID NO: 1181 (Rabat) | LCDR3 |
| SEQ ID NO: 1182 (Chothia) | LCDR1 |
| SEQ ID NO: 1183 (Chothia) | LCDR2 |
| SEQ ID NO: 1184 (Chothia) | LCDR3 |
| SEQ ID NO: 1185 (IMGT) | LCDR1 |
| SEQ ID NO: 1186 (IMGT) | LCDR2 |
| SEQ ID NO: 1187 (IMGT) | LCDR3 |
| SEQ ID NO: 1188 (Combined Chothia and Rabat) | LCDR1 |
| SEQ ID NO: 1189 (Combined Chothia and Rabat) | LCDR2 |
| SEQ ID NO: 1190 (Combined Chothia and Rabat) | LCDR3 |
| SEQ ID NO: 1191 | VL |
| SEQ ID NO: 1192 | DNA VL |
| SEQ ID NO: 1193 | Linker |
| SEQ ID NO: 1194 | scFv (VH-linker-VL) |
| SEQ ID NO: 1195 | DNA scFv (VH-linker-VL) |
| SEQ ID NO: 1196 | Full CAR amino acid sequence |
| SEQ ID NO: 1197 | Full CAR nucleic acid sequence |
| CD20-C5H4 | |
| SEQ ID NO: 1198 (Rabat) | HCDR1 |
| SEQ ID NO: 1199 (Rabat) | HCDR2 |
| SEQ ID NO: 1200 (Rabat) | HCDR3 |
| SEQ ID NO: 1201 (Chothia) | HCDR1 |
| SEQ ID NO: 1202 (Chothia) | HCDR2 |
| SEQ ID NO: 1203 (Chothia) | HCDR3 |
| SEQ ID NO: 1204 (IMGT) | HCDR1 |
| SEQ ID NO: 1205 (IMGT) | HCDR2 |
| SEQ ID NO: 1206 (IMGT) | HCDR3 |
| SEQ ID NO: 1207 (Combined Chothia and Rabat) | HCDR1 |
| SEQ ID NO: 1208 (Combined Chothia and Rabat) | HCDR2 |
| SEQ ID NO: 1209 (Combined Chothia and Rabat) | HCDR3 |
| SEQ ID NO: 1210 | VH |
| SEQ ID NO: 1211 | DNA VH |
| SEQ ID NO: 1212 (Rabat) | LCDR1 |
| SEQ ID NO: 1213 (Rabat) | LCDR2 |
| SEQ ID NO: 1214 (Rabat) | LCDR3 |
| SEQ ID NO: 1215 (Chothia) | LCDR1 |
| SEQ ID NO: 1216 (Chothia) | LCDR2 |
| SEQ ID NO: 1217 (Chothia) | LCDR3 |
| SEQ ID NO: 1218 (IMGT) | LCDR1 |
| SEQ ID NO: 1219 (IMGT) | LCDR2 |
| SEQ ID NO: 1220 (IMGT) | LCDR3 |
| SEQ ID NO: 1221 (Combined Chothia and Kabat) | LCDR1 |
| SEQ ID NO: 1222 (Combined Chothia and Kabat) | LCDR2 |
| SEQ ID NO: 1223 (Combined Chothia and Kabat) | LCDR3 |
| SEQ ID NO: 1224 | VL |
| SEQ ID NO: 1225 | DNA VL |
| SEQ ID NO: 1226 | Linker |

TABLE 32-continued

CD20 CAR sequences.

| SEQ ID NO | Ab region |
|---|---|
| SEQ ID NO: 1227 | scFv (VH-linker-VL) |
| SEQ ID NO: 1228 | DNA scFv (VH-linker-VL) |
| SEQ ID NO: 1229 | Full CAR amino acid sequence |
| SEQ ID NO: 1230 | Full CAR nucleic acid sequence |
| CD20-C8H1 | |
| SEQ ID NO: 1231 (Kabat) | HCDR1 |
| SEQ ID NO: 1232 (Kabat) | HCDR2 |
| SEQ ID NO: 1233 (Kabat) | HCDR3 |
| SEQ ID NO: 1234 (Chothia) | HCDR1 |
| SEQ ID NO: 1235 (Chothia) | HCDR2 |
| SEQ ID NO: 1236 (Chothia) | HCDR3 |
| SEQ ID NO: 1237 (IMGT) | HCDR1 |
| SEQ ID NO: 1238 (IMGT) | HCDR2 |
| SEQ ID NO: 1239 (IMGT) | HCDR3 |
| SEQ ID NO: 1240 (Combined Chothia and Kabat) | HCDR1 |
| SEQ ID NO: 1241 (Combined Chothia and Kabat) | HCDR2 |
| SEQ ID NO: 1242 (Combined Chothia and Kabat) | HCDR3 |
| SEQ ID NO: 1243 | VH |
| SEQ ID NO: 1244 | DNA VH |
| SEQ ID NO: 1245 (Kabat) | LCDR1 |
| SEQ ID NO: 1246 (Kabat) | LCDR2 |
| SEQ ID NO: 1247 (Kabat) | LCDR3 |
| SEQ ID NO: 1248 (Chothia) | LCDR1 |
| SEQ ID NO: 1249 (Chothia) | LCDR2 |
| SEQ ID NO: 1250 (Chothia) | LCDR3 |
| SEQ ID NO: 1251 (IMGT) | LCDR1 |
| SEQ ID NO: 1252 (IMGT) | LCDR2 |
| SEQ ID NO: 1253 (IMGT) | LCDR3 |
| SEQ ID NO: 1254 (Combined Chothia and Kabat) | LCDR1 |
| SEQ ID NO: 1255 (Combined Chothia and Kabat) | LCDR2 |
| SEQ ID NO: 1256 (Combined Chothia and Kabat) | LCDR3 |
| SEQ ID NO: 1257 | VL |
| SEQ ID NO: 1258 | DNA VL |
| SEQ ID NO: 1259 | Linker |
| SEQ ID NO: 1260 | scFv (VH-linker-VL) |
| SEQ ID NO: 1261 | DNA scFv (VH-linker-VL) |
| SEQ ID NO: 1262 | Full CAR amino acid sequence |
| SEQ ID NO: 1263 | Full CAR nucleic acid sequence |
| CD20-C8H2 | |
| SEQ ID NO: 1264 (Kabat) | HCDR1 |
| SEQ ID NO: 1265 (Kabat) | HCDR2 |
| SEQ ID NO: 1266 (Kabat) | HCDR3 |
| SEQ ID NO: 1267 (Chothia) | HCDR1 |
| SEQ ID NO: 1268 (Chothia) | HCDR2 |
| SEQ ID NO: 1269 (Chothia) | HCDR3 |
| SEQ ID NO: 1270 (IMGT) | HCDR1 |
| SEQ ID NO: 1271 (IMGT) | HCDR2 |
| SEQ ID NO: 1272 (IMGT) | HCDR3 |
| SEQ ID NO: 1273 (Combined Chothia and Kabat) | HCDR1 |
| SEQ ID NO: 1274 (Combined Chothia and Kabat) | HCDR2 |
| SEQ ID NO: 1275 (Combined Chothia and Kabat) | HCDR3 |
| SEQ ID NO: 1276 | VH |
| SEQ ID NO: 1277 | DNA VH |
| SEQ ID NO: 1278 (Kabat) | LCDR1 |
| SEQ ID NO: 1279 (Kabat) | LCDR2 |
| SEQ ID NO: 1280 (Kabat) | LCDR3 |
| SEQ ID NO: 1281 (Chothia) | LCDR1 |
| SEQ ID NO: 1282 (Chothia) | LCDR2 |
| SEQ ID NO: 1283 (Chothia) | LCDR3 |
| SEQ ID NO: 1284 (IMGT) | LCDR1 |
| SEQ ID NO: 1285 (IMGT) | LCDR2 |
| SEQ ID NO: 1286 (IMGT) | LCDR3 |
| SEQ ID NO: 1287 (Combined Chothia and Kabat) | LCDR1 |
| SEQ ID NO: 1288 (Combined Chothia and Kabat) | LCDR2 |
| SEQ ID NO: 1289 (Combined Chothia and Kabat) | LCDR3 |
| SEQ ID NO: 1290 | VL |
| SEQ ID NO: 1291 | DNA VL |
| SEQ ID NO: 1292 | Linker |
| SEQ ID NO: 1293 | scFv (VH-linker-VL) |
| SEQ ID NO: 1294 | DNA scFv (VH-linker-VL) |
| SEQ ID NO: 1295 | Full CAR amino acid sequence |
| SEQ ID NO: 1296 | Full CAR nucleic acid sequence |

TABLE 32-continued

CD20 CAR sequences.

| SEQ ID NO | Ab region |
|---|---|

CD20-C8H3

| SEQ ID NO | Ab region |
|---|---|
| SEQ ID NO: 1297 (Kabat) | HCDR1 |
| SEQ ID NO: 1298 (Kabat) | HCDR2 |
| SEQ ID NO: 1299 (Kabat) | HCDR3 |
| SEQ ID NO: 1300 (Chothia) | HCDR1 |
| SEQ ID NO: 1301 (Chothia) | HCDR2 |
| SEQ ID NO: 1302 (Chothia) | HCDR3 |
| SEQ ID NO: 1303 (IMGT) | HCDR1 |
| SEQ ID NO: 1304 (IMGT) | HCDR2 |
| SEQ ID NO: 1305 (IMGT) | HCDR3 |
| SEQ ID NO: 1306 (Combined Chothia and Kabat) | HCDR1 |
| SEQ ID NO: 1307 (Combined Chothia and Kabat) | HCDR2 |
| SEQ ID NO: 1308 (Combined Chothia and Kabat) | HCDR3 |
| SEQ ID NO: 1309 | VH |
| SEQ ID NO: 1310 | DNA VH |
| SEQ ID NO: 1311 (Rabat) | LCDR1 |
| SEQ ID NO: 1312 (Rabat) | LCDR2 |
| SEQ ID NO: 1313 (Rabat) | LCDR3 |
| SEQ ID NO: 1314 (Chothia) | LCDR1 |
| SEQ ID NO: 1315 (Chothia) | LCDR2 |
| SEQ ID NO: 1316 (Chothia) | LCDR3 |
| SEQ ID NO: 1317 (IMGT) | LCDR1 |
| SEQ ID NO: 1318 (IMGT) | LCDR2 |
| SEQ ID NO: 1319 (IMGT) | LCDR3 |
| SEQ ID NO: 1320 (Combined Chothia and Rabat) | LCDR1 |
| SEQ ID NO: 1321 (Combined Chothia and Rabat) | LCDR2 |
| SEQ ID NO: 1322 (Combined Chothia and Rabat) | LCDR3 |
| SEQ ID NO: 1323 | VL |
| SEQ ID NO: 1324 | DNA VL |
| SEQ ID NO: 1325 | Linker |
| SEQ ID NO: 1326 | scFv (VH-linker-VL) |
| SEQ ID NO: 1327 | DNA scFv (VH-linker-VL) |
| SEQ ID NO: 1328 | Full CAR amino acid sequence |
| SEQ ID NO: 1329 | Full CAR nucleic acid sequence |

CD20-C8H4

| SEQ ID NO | Ab region |
|---|---|
| SEQ ID NO: 1330 (Rabat) | HCDR1 |
| SEQ ID NO: 1331 (Rabat) | HCDR2 |
| SEQ ID NO: 1332 (Rabat) | HCDR3 |
| SEQ ID NO: 1333 (Chothia) | HCDR1 |
| SEQ ID NO: 1334 (Chothia) | HCDR2 |
| SEQ ID NO: 1335 (Chothia) | HCDR3 |
| SEQ ID NO: 1336 (IMGT) | HCDR1 |
| SEQ ID NO: 1337 (IMGT) | HCDR2 |
| SEQ ID NO: 1338 (IMGT) | HCDR3 |
| SEQ ID NO: 1339 (Combined Chothia and Rabat) | HCDR1 |
| SEQ ID NO: 1340 (Combined Chothia and Rabat) | HCDR2 |
| SEQ ID NO: 1341 (Combined Chothia and Rabat) | HCDR3 |
| SEQ ID NO: 1342 | VH |
| SEQ ID NO: 1343 | DNA VH |
| SEQ ID NO: 1344 (Rabat) | LCDR1 |
| SEQ ID NO: 1345 (Rabat) | LCDR2 |
| SEQ ID NO: 1346 (Rabat) | LCDR3 |
| SEQ ID NO: 1347 (Chothia) | LCDR1 |
| SEQ ID NO: 1348 (Chothia) | LCDR2 |
| SEQ ID NO: 1349 (Chothia) | LCDR3 |
| SEQ ID NO: 1350 (IMGT) | LCDR1 |
| SEQ ID NO: 1351 (IMGT) | LCDR2 |
| SEQ ID NO: 1352 (IMGT) | LCDR3 |
| SEQ ID NO: 1353 (Combined Chothia and Rabat) | LCDR1 |
| SEQ ID NO: 1354 (Combined Chothia and Rabat) | LCDR2 |
| SEQ ID NO: 1355 (Combined Chothia and Rabat) | LCDR3 |
| SEQ ID NO: 1356 | VL |
| SEQ ID NO: 1357 | DNA VL |
| SEQ ID NO: 1358 | Linker |
| SEQ ID NO: 1359 | scFv (VH-linker-VL) |
| SEQ ID NO: 1360 | DNA scFv (VH-linker-VL) |
| SEQ ID NO: 1361 | Full CAR amino acid sequence |
| SEQ ID NO: 1362 | Full CAR nucleic acid sequence |

CD20-C2

| SEQ ID NO | Ab region |
|---|---|
| SEQ ID NO: 1363 | VH |
| SEQ ID NO: 1364 | DNA VH |
| SEQ ID NO: 1365 | VL |
| SEQ ID NO: 1366 | DNA VL |

TABLE 32-continued

CD20 CAR sequences.

| SEQ ID NO | Ab region |
|---|---|
| CD20-C3 | |
| SEQ ID NO: 1367 | VH |
| SEQ ID NO: 1368 | DNA VH |
| SEQ ID NO: 1369 | VL |
| SEQ ID NO: 1370 | DNA VL |
| CD20-C5 | |
| SEQ ID NO: 1371 | VH |
| SEQ ID NO: 1372 | DNA VH |
| SEQ ID NO: 1373 | VL |
| SEQ ID NO: 1374 | DNA VL |
| CD20-C6 | |
| SEQ ID NO: 1375 | VH |
| SEQ ID NO: 1376 | DNA VH |
| SEQ ID NO: 1377 | VL |
| SEQ ID NO: 1378 | DNA VL |
| CD20-C7 | |
| SEQ ID NO: 1379 | VH |
| SEQ ID NO: 1380 | DNA VH |
| SEQ ID NO: 1381 | VL |
| SEQ ID NO: 1382 | DNA VL |
| CD20-C8 | |
| SEQ ID NO: 1383 | VH |
| SEQ ID NO: 1384 | DNA VH |
| SEQ ID NO: 1385 | VL |
| SEQ ID NO: 1386 | DNA VL |
| CD20-3m | |
| SEQ ID NO: 1387 | VH |
| SEQ ID NO: 1388 | DNA VH |
| SEQ ID NO: 1389 | VL |
| SEQ ID NO: 1390 | DNA VL |
| SEQ ID NO: 1391 | Linker |
| SEQ ID NO: 1392 | scFv (VH-linker-VL) |
| CD20-3J | |
| SEQ ID NO: 1393 | VH |
| SEQ ID NO: 1394 | DNA VH |
| SEQ ID NO: 1395 | VL |
| SEQ ID NO: 1396 | DNA VL |
| SEQ ID NO: 1397 | Linker |
| SEQ ID NO: 1398 | scFv (VH-linker-VL) |
| CD20-3H5k1 | |
| SEQ ID NO: 1399 | VH |
| SEQ ID NO: 1400 | DNA VH |
| SEQ ID NO: 1401 | VL |
| SEQ ID NO: 1402 | DNA VL |
| SEQ ID NO: 1403 | Linker |
| SEQ ID NO: 1404 | scFv (VH-linker-VL) |
| CD20-3H5k3 | |
| SEQ ID NO: 1405 | VH |
| SEQ ID NO: 1406 | DNA VH |
| SEQ ID NO: 1407 | VL |
| SEQ ID NO: 1408 | DNA VL |
| SEQ ID NO: 1409 | Linker |
| SEQ ID NO: 1410 | scFv (VH-linker-VL) |
| CD20-Ofa | |
| SEQ ID NO: 1411 (Rabat) | HCDR1 |
| SEQ ID NO: 1412 (Rabat) | HCDR2 |
| SEQ ID NO: 1413 (Rabat) | HCDR3 |
| SEQ ID NO: 1414 (Chothia) | HCDR1 |
| SEQ ID NO: 1415 (Chothia) | HCDR2 |
| SEQ ID NO: 1416 (Chothia) | HCDR3 |
| SEQ ID NO: 1417 (IMGT) | HCDR1 |
| SEQ ID NO: 1418 (IMGT) | HCDR2 |
| SEQ ID NO: 1419 (IMGT) | HCDR3 |
| SEQ ID NO: 1420 | VH |
| SEQ ID NO: 1421 | DNA VH |
| SEQ ID NO: 1422 (Rabat) | LCDR1 |

TABLE 32-continued

CD20 CAR sequences.

| SEQ ID NO | Ab region |
|---|---|
| SEQ ID NO: 1423 (Rabat) | LCDR2 |
| SEQ ID NO: 1424 (Rabat) | LCDR3 |
| SEQ ID NO: 1425 (Chothia) | LCDR1 |
| SEQ ID NO: 1426 (Chothia) | LCDR2 |
| SEQ ID NO: 1427 (Chothia) | LCDR3 |
| SEQ ID NO: 1428 (IMGT) | LCDR1 |
| SEQ ID NO: 1429 (IMGT) | LCDR2 |
| SEQ ID NO: 1430 (IMGT) | LCDR3 |
| SEQ ID NO: 1431 | VL |
| SEQ ID NO: 1432 | DNA VL |
| SEQ ID NO: 1433 | Linker |
| SEQ ID NO: 1434 | scFv (VH-linker-VL) |
| SEQ ID NO: 1435 | DNA scFv (VH-linker-VL) |
| CD20-3 | |
| SEQ ID NO: 1436 | VH |
| SEQ ID NO: 1437 | VL |
| SEQ ID NO: 1438 | Linker |
| SEQ ID NO: 1439 | scFv (VH-linker-VL) |
| CD20-8aBBz | |
| SEQ ID NO: 1440 | VH |
| SEQ ID NO: 1441 | DNA VH |
| SEQ ID NO: 1442 | VL |
| SEQ ID NO: 1443 | DNA VL |
| SEQ ID NO: 1444 | Linker |
| SEQ ID NO: 1445 | scFv (VH-linker-VL) |
| SEQ ID NO: 1446 | DNA scFv (VH-linker-VL) |

CLL-1 CAR

In other embodiments, the CAR-expressing cells can specifically bind to CLL-1, e.g., can include a CAR molecule, or an antigen binding domain according to Table 2 of WO2016/014535, incorporated herein by reference. Exemplary amino acid and nucleotide sequences encoding the CLL-1 CAR molecules and antigen binding domains (e.g., including one, two, three VH CDRs; and one, two, three VL CDRs according to Kabat or Chothia) are provided in WO2016/014535.

GFR ALPHA-4

In other embodiments, the CAR-expressing cells can specifically bind to GFR ALPHA-4, e.g., can include a CAR molecule, or an antigen binding domain according to Table 2 of WO2016/025880, incorporated herein by reference. Exemplary amino acid and nucleotide sequences encoding the GFR ALPHA-4 CAR molecules and antigen binding domains (e.g., including one, two, three VH CDRs; and one, two, three VL CDRs according to Kabat or Chothia) are provided in WO2016/025880.

In one embodiment, the antigen binding domain of any of the CAR molecules described herein (e.g., any of CD19, CD123, EGFRvIII, CD33, mesothelin, BCMA, and GFR ALPHA-4) comprises one, two, or three (e.g., all three) heavy chain CDRs, HC CDR1, HC CDR2 and HC CDR3, from an antibody listed above, and/or one, two, or three (e.g., all three) light chain CDRs, LC CDR1, LC CDR2 and LC CDR3, from an antigen binding domain listed above. In one embodiment, the antigen binding domain comprises a heavy chain variable region and/or a variable light chain region of an antibody listed or described above.

In one aspect, the anti-tumor antigen binding domain is a fragment, e.g., a single chain variable fragment (scFv). In one aspect, the anti-a cancer associate antigen as described herein binding domain is a Fv, a Fab, a (Fab')2, or a bi-functional (e.g. bi-specific) hybrid antibody (e.g., Lanzavecchia et al., Eur. J. Immunol. 17, 105 (1987)). In one aspect, the antibodies and fragments thereof of the invention binds a cancer associate antigen as described herein protein with wild-type or enhanced affinity.

In some instances, scFvs can be prepared according to method known in the art (see, for example, Bird et al., (1988) Science 242:423-426 and Huston et al., (1988) Proc. Natl. Acad. Sci. USA 85:5879-5883). ScFv molecules can be produced by linking VH and VL regions together using flexible polypeptide linkers. The scFv molecules comprise a linker (e.g., a Ser-Gly linker) with an optimized length and/or amino acid composition. The linker length can greatly affect how the variable regions of a scFv fold and interact. In fact, if a short polypeptide linker is employed (e.g., between 5-10 amino acids) intrachain folding is prevented. Interchain folding is also required to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, is incorporated herein by reference.

In another aspect, the antigen binding domain is a T cell receptor ("TCR"), or a fragment thereof, for example, a single chain TCR (scTCR). Methods to make such TCRs are known in the art. See, e.g., Willemsen R A et al, Gene Therapy 7: 1369-1377 (2000); Zhang T et al, Cancer Gene Ther 11: 487-496 (2004); Aggen et al, Gene Ther. 19(4): 365-74 (2012) (references are incorporated herein by its entirety). For example, scTCR can be engineered that contains the Va and Vl3 genes from a T cell clone linked by a linker (e.g., a flexible peptide). This approach is very useful to cancer associated target that itself is intracellular, however, a fragment of such antigen (peptide) is presented on the surface of the cancer cells by MHC.

Additional Exemplary Antigen Binding Domains and CARs

In one embodiment, an antigen binding domain against GD2 is an antigen binding portion, e.g., CDRs, of an antibody described in, e.g., Mujoo et al., Cancer Res. 47(4):1098-1104 (1987); Cheung et al., Cancer Res 45(6): 2642-2649 (1985), Cheung et al., J Clin Oncol 5(9):1430-1440 (1987), Cheung et al., J Clin Oncol 16(9):3053-3060 (1998), Handgretinger et al., Cancer Immunol Immunother 35(3):199-204 (1992). In some embodiments, an antigen binding domain against GD2 is an antigen binding portion of an antibody selected from mAb 14.18, 14G2a, ch14.18, hu14.18, 3F8, hu3F8, 3G6, 8B6, 60C3, 10B8, ME36.1, and 8H9, see e.g., WO2012033885, WO2013040371, WO2013192294, WO2013061273, WO2013123061, WO2013074916, and WO201385552. In some embodiments, an antigen binding domain against GD2 is an antigen binding portion of an antibody described in US Publication No.: 20100150910 or PCT Publication No.: WO 2011160119.

In one embodiment, an antigen binding domain against the Tn antigen, the sTn antigen, a Tn-O-glycopeptide antigen, or a sTn-O-glycopeptide antigen is an antigen binding portion, e.g., CDRs, of an antibody described in, e.g., US 2014/0178365, U.S. Pat. No. 8,440,798, EP 2083868 A2, Brooks et al., PNAS 107(22):10056-10061 (2010), and Stone et al., OncoImmunology 1(6):863-873 (2012).

In one embodiment, an antigen binding domain against PSMA is an antigen binding portion, e.g., CDRs, of an antibody described in, e.g., Parker et al., Protein Expr Purif 89(2):136-145 (2013), US 20110268656 (J591 ScFv); Frigerio et al, European J Cancer 49(9):2223-2232 (2013) (scFvD2B); WO 2006125481 (mAbs 3/A12, 3/E7 and 3/F11) and single chain antibody fragments (scFv A5 and D7).

In one embodiment, an antigen binding domain against CD97 is an antigen binding portion, e.g., CDRs, of an antibody described in, e.g., U.S. Pat. No. 6,846,911; de Groot et al., J Immunol 183(6):4127-4134 (2009); or an antibody from R&D:MAB3734.

In one embodiment, an antigen binding domain against TAG72 is an antigen binding portion, e.g., CDRs, of an antibody described in, e.g., Hombach et al., Gastroenterology 113(4):1163-1170 (1997); and Abcam ab691.

In one embodiment, an antigen binding domain against CD44v6 is an antigen binding portion, e.g., CDRs, of an antibody described in, e.g., Casucci et al., Blood 122(20):3461-3472 (2013).

In one embodiment, an antigen binding domain against CEA is an antigen binding portion, e.g., CDRs, of an antibody described in, e.g., Chmielewski et al., Gastoenterology 143(4):1095-1107 (2012).

In one embodiment, an antigen binding domain against EPCAM is an antigen binding portion, e.g., CDRS, of an antibody selected from MT110, EpCAM-CD3 bispecific Ab (see, e.g., clinicaltrials.gov/ct2/show/NCT00635596); Edrecolomab; 3622W94; ING-1; and adecatumumab (MT201).

In one embodiment, an antigen binding domain against KIT is an antigen binding portion, e.g., CDRs, of an antibody described in, e.g., U.S. Pat. No. 7,915,391, US20120288506, and several commercial catalog antibodies.

In one embodiment, an antigen binding domain against IL-13Ra2 is an antigen binding portion, e.g., CDRs, of an antibody described in, e.g., WO2008/146911, WO2004087758, several commercial catalog antibodies, and WO2004087758.

In one embodiment, an antigen binding domain against CD171 is an antigen binding portion, e.g., CDRs, of an antibody described in, e.g., Hong et al., J Immunother 37(2):93-104 (2014).

In one embodiment, an antigen binding domain against PSCA is an antigen binding portion, e.g., CDRs, of an antibody described in, e.g., Morgenroth et al., Prostate 67(10):1121-1131 (2007) (scFv 7F5); Nejatollahi et al., J of Oncology 2013 (2013), article ID 839831 (scFv C5-II); and US Pat Publication No. 20090311181.

In one embodiment, an antigen binding domain against MAD-CT-2 is an antigen binding portion, e.g., CDRs, of an antibody described in, e.g., PMID: 2450952; U.S. Pat. No. 7,635,753.

In one embodiment, an antigen binding domain against Folate receptor alpha is an antigen binding portion, e.g., CDRs, of the antibody IMGN853, or an antibody described in US20120009181; U.S. Pat. No. 4,851,332, LK26: U.S. Pat. No. 5,952,484.

In one embodiment, an antigen binding domain against ERBB2 (Her2/neu) is an antigen binding portion, e.g., CDRs, of the antibody trastuzumab, or pertuzumab.

In one embodiment, an antigen binding domain against MUC1 is an antigen binding portion, e.g., CDRs, of the antibody SAR566658.

In one embodiment, the antigen binding domain against EGFR is antigen binding portion, e.g., CDRs, of the antibody cetuximab, panitumumab, zalutumumab, nimotuzumab, or matuzumab.

In one embodiment, an antigen binding domain against NCAM is an antigen binding portion, e.g., CDRs, of the antibody clone 2-2B: MAB5324 (EMD Millipore)

In one embodiment, an antigen binding domain against CAIX is an antigen binding portion, e.g., CDRs, of the antibody clone 303123 (R&D Systems).

In one embodiment, an antigen binding domain against Fos-related antigen 1 is an antigen binding portion, e.g., CDRs, of the antibody 12F9 (Novus Biologicals).

In one embodiment, an antigen binding domain against SSEA-4 is an antigen binding portion, e.g., CDRs, of antibody MC813 (Cell Signaling), or other commercially available antibodies.

In one embodiment, an antigen binding domain against PDGFR-beta is an antigen binding portion, e.g., CDRs, of an antibody Abcam ab32570.

In one embodiment, an antigen binding domain against ALK is an antigen binding portion, e.g., CDRs, of an antibody described in, e.g., Mino-Kenudson et al., Clin Cancer Res 16(5):1561-1571 (2010).

In one embodiment, an antigen binding domain against plysialic acid is an antigen binding portion, e.g., CDRs, of an antibody described in, e.g., Nagae et al., J Biol Chem 288(47):33784-33796 (2013).

In one embodiment, an antigen binding domain against PLAC1 is an antigen binding portion, e.g., CDRs, of an antibody described in, e.g., Ghods et al., Biotechnol Appl Biochem 2013 doi:10.1002/bab.1177.

In one embodiment, an antigen binding domain against GloboH is an antigen binding portion of the antibody VK9; or an antibody described in, e.g., Kudryashov V et al, Glycoconj J.15(3):243-9 (1998), Lou et al., Proc Natl Acad Sci USA 111(7):2482-2487 (2014); MBrl: Bremer E-G et al. J Biol Chem 259:14773-14777 (1984).

In one embodiment, an antigen binding domain against NY-BR-1 is an antigen binding portion, e.g., CDRs of an antibody described in, e.g., Jager et al., Appl Immunohistochem Mol Morphol 15(1):77-83 (2007).

In one embodiment, an antigen binding domain against sperm protein 17 is an antigen binding portion, e.g., CDRs, of an antibody described in, e.g., Song et al., Target Oncol 2013 Aug. 14 (PMID: 23943313); Song et al., Med Oncol 29(4):2923-2931 (2012).

In one embodiment, an antigen binding domain against TRP-2 is an antigen binding portion, e.g., CDRs, of an antibody described in, e.g., Wang et al, J Exp Med. 184(6): 2207-16 (1996).

In one embodiment, an antigen binding domain against CYP1B1 is an antigen binding portion, e.g., CDRs, of an antibody described in, e.g., Maecker et al, Blood 102 (9): 3287-3294 (2003).

In one embodiment, an antigen binding domain against RAGE-1 is an antigen binding portion, e.g., CDRs, of the antibody MAB5328 (EMD Millipore).

In one embodiment, an antigen binding domain against human telomerase reverse transcriptase is an antigen binding portion, e.g., CDRs, of the antibody cat no: LS-B95-100 (Lifespan Biosciences)

In one embodiment, an antigen binding domain against intestinal carboxyl esterase is an antigen binding portion, e.g., CDRs, of the antibody 4F12: cat no: LS-B6190-50 (Lifespan Biosciences).

In one embodiment, an antigen binding domain against mut hsp70-2 is an antigen binding portion, e.g., CDRs, of the antibody Lifespan Biosciences: monoclonal: cat no: LS-C133261-100 (Lifespan Biosciences).

In one embodiment, an antigen binding domain against MAD-CT-2 is an antigen binding portion, e.g., CDRs, of an antibody described in, e.g., PMID: 2450952; U.S. Pat. No. 7,635,753.

In one embodiment, the antigen binding domain comprises one, two, or three (e.g., all three) heavy chain CDRs, HC CDR1, HC CDR2 and HC CDR3, from an antibody listed above, and/or one, two, or three (e.g., all three) light chain CDRs, LC CDR1, LC CDR2 and LC CDR3, from an antibody listed above. In one embodiment, the antigen binding domain comprises a heavy chain variable region and/or a variable light chain region of an antibody listed above.

In some embodiments, the antigen binding domain of a CAR targets a tumor antigen that is an antigen expressed on a myeloid tumor (either a surface antigen or presented by MHC), and a cell comprising such a CAR recognizes a myeloid tumor antigen.

In an embodiment, the myeloid tumor antigen is an antigen that is preferentially or specifically expressed on the surface of a myeloid tumor cell.

In one embodiment, the antigen-binding domain of a CAR can be chosen such that a myeloid tumor population is targeted. Alternatively, when targeting of more than one type of myeloid tumor is desired, an antigen binding domain that targets a myeloid tumor antigen that is expressed by more than one, e.g., all, of the myeloid tumors to be targeted can be selected.

A CAR can target the following additional tumor antigens: CD123, CD34, Flt3, CD33 and CLL-1. In embodiments, the tumor antigen is selected from CD123, CD33 and CLL-1. In some embodiments, the tumor antigen is CD123. In some embodiments, the tumor antigen is CD33. In some embodiments, the tumor antigen is CD34. In some embodiments, the tumor antigen is Flt3. In embodiments, the tumor antigen is CLL-1. In embodiments, the antigen binding domain targets the human antigen.

In one aspect, the antigen-binding domain of a CAR binds to CD123, e.g., human CD123. Any known CD123 binding domain may be used in the invention. In one embodiment, an antigen binding domain against CD123 is an antigen binding portion, e.g., CDRs or VH and VL, of an antibody, antigen-binding fragment or CAR described in, e.g., PCT publication WO2014/130635, incorporated herein by reference. In one embodiment, an antigen binding domain against CD123 is an antigen binding portion, e.g., CDRs or VH and VL, of an antibody, antigen-binding fragment or CAR described in, e.g., PCT publication WO/2016/028896, incorporated herein by reference. In one embodiment, an antigen binding domain against CD123 is an antigen binding portion, e.g., CDRs, of an antibody, antigen-binding fragment, or CAR described in, e.g., PCT publication WO1997/024373, WO2008/127735 (e.g., a CD123 binding domain of 26292, 32701, 37716 or 32703), WO2014/138805 (e.g., a CD123 binding domain of CSL362), WO2014/138819, WO2013/173820, WO2014/144622, WO2001/66139, WO2010/126066 (e.g., the CD123 binding domain of any of Old4, Old5, Old17, Old19, New102, or Old6), WO2014/144622, WO2016/028896, or US2009/0252742, incorporated herein by reference. In embodiments, the antigen binding domain is or is derived from a murine anti-human CD123 binding domain. In embodiments, the antigen binding domain is a humanized antibody or antibody fragment, e.g., scFv domain. In an embodiment, the antigen binding domain is a human antibody or antibody fragment that binds to human CD123. In embodiments, the antigen binding domain is an scFv domain which includes a light chain variable region (VL) and a heavy chain variable region (VH). The VL and VH may attached by a linker described herein, e.g., comprising the sequence GGGGSGGGGSGGGGS (SEQ ID NO: 142), and may be in any orientation, e.g., VL-linker-VH, or VH-linker-VL.

In some embodiments, the antigen binding domain of a CAR targets a B-Cell antigen. In an embodiment, the B cell antigen is an antigen that is preferentially or specifically expressed on the surface of the B cell. The antigen can be expressed on the surface of any one of the following types of B cells: progenitor B cells (e.g., pre-B cells or pro-B cells), early pro-B cells, late pro-B cells, large pre-B cells, small pre-B cells, immature B cells, e.g., naïve B cells, mature B cells, plasma B cells, plasmablasts, memory B cells, B-1 cells, B-2 cells, marginal-zone B cells, follicular B cells, germinal center B cells, or regulatory B cells (Bregs).

The present disclosure provides CARs that can target the following antigens: CD19; CD123; CD22; CD30; CD171; CS-1; C-type lectin-like molecule-1, CD33; epidermal growth factor receptor variant III (EGFRvIII); ganglioside G2 (GD2); ganglioside GD3; TNF receptor family member; B-cell maturation antigen; Tn antigen ((Tn Ag) or (GalNAcα-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EPCAM); B7H3 (CD276); KIT (CD117); Interleukin-13 receptor subunit alpha-2; Mesothelin; Interleukin 11 receptor alpha (IL-11Ra); prostate stem cell antigen (PSCA); Protease Serine 21; vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3; transglutaminase 5 (TGS5); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 ($OR_{51}E2$); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1, melanoma antigen recognized by T cells 1; Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like, Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); immunoglobulin lambda-like polypeptide 1 (IGLL1); TNF receptor family member; Fms-Like Tyrosine Kinase 3 (FL T3); CD10, CD19, CD20, CD21, CD22, CD23, CD24, CD25, CD37, CD38, CD53, CD72, CD73, CD74, CD75, CD77, CD79a, CD79b, CD80, CD81, CD82, CD83, CD84, CD85, ROR1, BCMA, CD86, and CD179b. Other B cell antigens that can be targeted by a CAR described herein include: CD1a, CD1b, CD1c, CD1d, CD2, CD5, CD6, CD9, CD11a, CD11b, CD11c, CD17, CD18, CD26, CD27, CD29, CD30, CD31, CD32a, CD32b, CD35, CD38, CD39, CD40, CD44, CD45, CD45RA, CD45RB, CD45RC, CD45RO, CD46, CD47, CD48, CD49b, CD49c, CD49d, CD50, CD52, CD54, CD55, CD58, CD60a, CD62L, CD63, CD63, CD68 CD69, CD70, CD85E, CD85I, CD85J, CD92, CD95, CD97, CD98, CD99, CD100, CD102, CD108, CD119, CD120a, CD120b, CD121b, CD122, CD124, CD125, CD126, CD130, CD132, CD137, CD138, CD139, CD147, CD148, CD150, CD152, CD162, CD164, CD166, CD167a, CD170, CD175, CD175s, CD180, CD184, CD185, CD192, CD196, CD197, CD200, CD205, CD210a, CDw210b, CD212, CD213a1, CD213a2, CD215, CD217, CD218a, CD218b, CD220, CD221, CD224, CD225, CD226, CD227, CD229, CD230, CD232, CD252, CD253, CD257, CD258, CD261, CD262, CD263, CD264, CD267, CD268, CD269, CD270, CD272, CD274, CD275, CD277, CD279, CD283, CD289, CD290, CD295, CD298, CD300a, CD300c, CD305, CD306, CD307a, CD307b, CD307c, CD307d, CD307e, CD314, CD315, CD316, CD317, CD319, CD321, CD327, CD328, CD329, CD338, CD351, CD352, CD353, CD354, CD355, CD357, CD358, CD360, CD361, CD362, and CD363.

In another embodiment, the antigen targeted by the CAR is chosen from CD19, BCMA, CD20, CD22, FcRn5, FcRn2, CS-1 and CD138. In an embodiment, the antigen targeted by the CAR is CD19. In an embodiment, the antigen targeted by the CAR is CD20. In an embodiment, the antigen targeted by the CAR is CD22. In an embodiment, the antigen targeted by the CAR is BCMA. In an embodiment, the antigen targeted by the CAR is FcRn5. In an embodiment, the antigen targeted by the CAR is FcRn2. In an embodiment, the antigen targeted by the CAR is CS-1. In an embodiment, the antigen targeted by the CAR is CD138.

In one embodiment, the antigen-binding domain of a CAR, e.g., the CAR expressed by a cell of the invention (e.g., a cell that also expresses a CAR), can be chosen such that a preferred B cell population is targeted. For example, in an embodiment where targeting of B regulatory cells is desired, an antigen binding domain is selected that targets an antigen that is expressed on regulatory B cells and not on other B cell populations, e.g., plasma B cells and memory B cells. Cell surface markers expressed on regulatory B cells include: CD19, CD24, CD25, CD38, or CD86, or markers described in He et al., 2014, *J Immunology Research*, Article ID 215471. When targeting of more than one type of B cells is desired, an antigen binding domain that targets an antigen that is expressed by all of the B cells to be targeted can be selected.

CAR Transmembrane Domain

With respect to the transmembrane domain, in various embodiments, a CAR can be designed to comprise a transmembrane domain that is attached to the extracellular domain of the CAR. A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is one that is associated with one of the other domains of the CAR. In some instances, the transmembrane domain can be selected or modified by amino acid substitution to avoid binding of such domains to the transmembrane domains of the same or different surface membrane proteins, e.g., to minimize interactions with other members of the receptor complex. In one aspect, the transmembrane domain is capable of homodimerization with another CAR on the cell surface of a CAR-expressing cell. In a different aspect, the amino acid sequence of the transmembrane domain may be modified or substituted so as to minimize interactions with the binding domains of the native binding partner present in the same CART.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain of particular use in this invention may include at least the transmembrane region(s) of e.g., the alpha, beta or zeta chain of the T-cell receptor, CD28, CD27, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIR2DS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7Rα, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, NKG2C.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge, e.g., an IgG4 hinge, or a CD8a hinge. In one embodiment, the hinge or spacer comprises (e.g., consists of) the amino acid sequence of SEQ ID NO: 147. In one aspect, the transmembrane domain comprises (e.g., consists of) a transmembrane domain of SEQ ID NO: 155.

In one aspect, the hinge or spacer comprises an IgG4 hinge. For example, in one embodiment, the hinge or spacer comprises a hinge of the amino acid sequence ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQ VYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM (SEQ ID NO: 149). In some embodiments, the hinge or spacer comprises a hinge encoded by a nucleotide sequence of (SEQ ID NO: 150)
GAGAGCAAGTACGGCCCTCCCTGCCCCCCTTGCCCTGCCCCCGAGTTC

CTGGGCGGACCCAGCGTGTTCCTGTTCCCCCCCAAGCCCAAGGACACC

CTGATGATCAGCCGGACCCCCGAGGTGACCTGTGTGGTGGTGGACGTG

TCCCAGGAGGACCCCGAGGTCCAGTTCAACTGGTACGTGGACGGCGTG

GAGGTGCACAACGCCAAGACCAAGCCCCGGGAGGAGCAGTTCAATAGC

ACCTACCGGGTGGTGTCCGTGCTGACCGTGCTGCACCAGGACTGGCTG

AACGGCAAGGAATACAAGTGTAAGGTGTCCAACAAGGGCCTGCCCAGC

AGCATCGAGAAAACCATCAGCAAGGCCAAGGGCCAGCCTCGGGAGCCC

CAGGTGTACACCCTGCCCCCTAGCCAAGAGGAGATGACCAAGAACCAG

GTGTCCCTGACCTGCCTGGTGAAGGGCTTCTACCCCAGCGACATCGCC

GTGGAGTGGGAGAGCAACGGCCAGCCCGAGAACAACTACAAGACCACC

CCCCCTGTGCTGGACAGCGACGGCAGCTTCTTCCTGTACAGCCGGCTG

ACCGTGGACAAGAGCCGGTGGCAGGAGGGCAACGTCTTTAGCTGCTCC

GTGATGCACGAGGCCCTGCACAACCACTACACCCAGAAGAGCCTGAGC

CTGTCCCTGGGCAAGATG.

In one aspect, the hinge or spacer comprises an IgD hinge. For example, in one embodiment, the hinge or spacer comprises a hinge of the amino acid sequence RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAAS WLLCEVSGFSPPNILLMWLEDQREVNTSGFAPARPPPQPGSTTFWAWSVLRVPAPPSPQPATYTC VVSHEDSRTLLNASRSLEVSYVTDH (SEQ ID NO: 151). In some embodiments, the hinge or spacer comprises a hinge encoded by a nucleotide sequence of (SEQ ID NO: 152)
AGGTGGCCCGAAAGTCCCAAGGCCCAGGCATCTAGTGTTCCTACTGCA

CAGCCCCAGGCAGAAGGCAGCCTAGCCAAAGCTACTACTGCACCTGCC

ACTACGCGCAATACTGGCCGTGGCGGGAGGAGAAGAAAAAGGAGAAA

GAGAAAGAAGAACAGGAAGAGAGGGAGACCAAGACCCCTGAATGTCCA

TCCCATACCCAGCCGCTGGGCGTCTATCTCTTGACTCCCGCAGTACAG

GACTTGTGGCTTAGAGATAAGGCCACCTTTACATGTTTCGTCGTGGGC

TCTGACCTGAAGGATGCCCATTTGACTTGGGAGGTTGCCGGAAAGGTA

CCCACAGGGGGGTTGAGGAAGGGTTGCTGGAGCGCCATTCCAATGGC

TCTCAGAGCCAGCACTCAAGACTCACCCTTCCGAGATCCCTGTGGAAC

GCCGGGACCTCTGTCACATGTACTCTAAATCATCCTAGCCTGCCCCCA

CAGCGTCTGATGGCCCTTAGAGAGCCAGCCGCCCAGGCACCAGTTAAG

CTTAGCCTGAATCTGCTCGCCAGTAGTGATCCCCAGAGGCCGCCAGC

TGGCTCTTATGCGAAGTGTCCGGCTTTAGCCCGCCCAACATCTTGCTC

ATGTGGCTGGAGGACCAGCGAGAAGTGAACACCAGCGGCTTCGCTCCA

GCCCGGCCCCCACCCCAGCCGGGTTCTACCACATTCTGGGCCTGGAGT

-continued

GTCTTAAGGGTCCCAGCACCACCTAGCCCCCAGCCAGCCACATACACC

TGTGTTGTGTCCCATGAAGATAGCAGGACCCTGCTAAATGCTTCTAGG

AGTCTGGAGGTTTCCTACGTGACTGACCATT.

In one aspect, the transmembrane domain may be recombinant, in which case it will comprise predominantly hydrophobic residues such as leucine and valine. In one aspect a triplet of phenylalanine, tryptophan and valine can be found at each end of a recombinant transmembrane domain.

Optionally, a short oligo- or polypeptide linker, between 2 and 10 amino acids in length may form the linkage between the transmembrane domain and the cytoplasmic region of the CAR. A glycine-serine doublet provides a particularly suitable linker. For example, in one aspect, the linker comprises the amino acid sequence of GGGGSGGGGS (SEQ ID NO: 153). In some embodiments, the linker is encoded by a nucleotide sequence of GGTGGCGGAGGTTCTGGAGGTGGAGGTTCC (SEQ ID NO: 154).

In one aspect, the hinge or spacer comprises a KIR2DS2 hinge.

Cytoplasmic Domain

The cytoplasmic domain or region of the CAR includes an intracellular signaling domain. An intracellular signaling domain is generally responsible for activation of at least one of the normal effector functions of the immune cell in which the CAR has been introduced.

Examples of intracellular signaling domains for use in a CAR described herein include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

It is known that signals generated through the TCR alone are insufficient for full activation of the T cell and that a secondary and/or costimulatory signal is also required. Thus, T cell activation can be said to be mediated by two distinct classes of cytoplasmic signaling sequences: those that initiate antigen-dependent primary activation through the TCR (primary intracellular signaling domains) and those that act in an antigen-independent manner to provide a secondary or costimulatory signal (secondary cytoplasmic domain, e.g., a costimulatory domain).

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains that are of particular use in the invention include those of TCR zeta, FcR gamma, FcR beta, CD3 gamma, CD3 delta, CD3 epsilon, CD5, CD22, CD79a, CD79b, CD278 (also known as "ICOS"), FcεRI, DAP10, DAP12, and CD66d. In one embodiment, a CAR of the invention comprises an intracellular signaling domain, e.g., a primary signaling domain of CD3-zeta, e.g., a CD3-zeta sequence described herein.

In one embodiment, a primary signaling domain comprises a modified ITAM domain, e.g., a mutated ITAM domain which has altered (e.g., increased or decreased) activity as compared to the native ITAM domain. In one embodiment, a primary signaling domain comprises a modified ITAM-containing primary intracellular signaling domain, e.g., an optimized and/or truncated ITAM-containing primary intracellular signaling domain. In an embodiment, a primary signaling domain comprises one, two, three, four or more ITAM motifs.

Costimulatory Signaling Domain

The intracellular signalling domain of the CAR can comprise the CD3-zeta signaling domain by itself or it can be combined with any other desired intracellular signaling domain(s) useful in the context of a CAR of the invention. For example, the intracellular signaling domain of the CAR can comprise a CD3 zeta chain portion and a costimulatory signaling domain. The costimulatory signaling domain refers to a portion of the CAR comprising the intracellular domain of a costimulatory molecule. In one embodiment, the intracellular domain is designed to comprise the signaling domain of CD3-zeta and the signaling domain of CD28. In one aspect, the intracellular domain is designed to comprise the signaling domain of CD3-zeta and the signaling domain of ICOS.

A costimulatory molecule can be a cell surface molecule other than an antigen receptor or its ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that specifically binds with CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3):696-706). Further examples of such costimulatory molecules include CDS, ICAM-1, GITR, BAFFR, HVEM (LIGHTR), SLAMF7, NKp80 (KLRF1), NKp30, NKp44, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, NKG2D, NKG2C and PAG/Cbp.

The intracellular signaling sequences within the cytoplasmic portion of the CAR may be linked to each other in a random or specified order. Optionally, a short oligo- or polypeptide linker, for example, between 2 and 10 amino acids (e.g., 2, 3, 4, 5, 6, 7, 8, 9, or 10 amino acids) in length may form the linkage between intracellular signaling sequence. In one embodiment, a glycine-serine doublet can be used as a suitable linker. In one embodiment, a single amino acid, e.g., an alanine, a glycine, can be used as a suitable linker.

In one aspect, the intracellular signaling domain is designed to comprise two or more, e.g., 2, 3, 4, 5, or more, costimulatory signaling domains. In an embodiment, the two or more, e.g., 2, 3, 4, 5, or more, costimulatory signaling domains, are separated by a linker molecule, e.g., a linker molecule described herein. In one embodiment, the intracellular signaling domain comprises two costimulatory signaling domains. In some embodiments, the linker molecule is a glycine residue. In some embodiments, the linker is an alanine residue.

In one aspect, the intracellular signaling domain is designed to comprise the signaling domain of CD3-zeta and the signaling domain of CD28. In one aspect, the intracellular signaling domain is designed to comprise the signaling domain of CD3-zeta and the signaling domain of 4-1BB. In one aspect, the signaling domain of 4-1BB is a signaling domain of SEQ ID NO: 158. In one aspect, the signaling domain of CD3-zeta is a signaling domain of SEQ ID NO: 163.

In one aspect, the intracellular signaling domain is designed to comprise the signaling domain of CD3-zeta and the signaling domain of CD27. In one aspect, the signaling domain of CD27 comprises an amino acid sequence of QRRKYRSNKGESPVEPAEPCRYSCPREEEGSTIP-IQEDYRKPEPACSP (SEQ ID NO: 161). In one aspect, the signalling domain of CD27 is encoded by a nucleic acid sequence of

```
                                    (SEQ ID NO: 162)
AGGAGTAAGAGGAGCAGGCTCCTGCACAGTGACTACATGAACATGACT

CCCCGCCGCCCCGGGCCCACCCGCAAGCATTACCAGCCCTATGCCCCA

CCACGCGACTTCGCAGCCTATCGCTCC.
```

In one aspect, the CAR-expressing cell described herein can further comprise a second CAR, e.g., a second CAR that includes a different antigen binding domain, e.g., to the same target or a different target (e.g., a target other than a cancer associated antigen described herein or a different cancer associated antigen described herein, e.g., CD19, CD33, CLL-1, CD34, FLT3, or folate receptor beta). In one embodiment, the second CAR includes an antigen binding domain to a target expressed the same cancer cell type as the cancer associated antigen. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, ICOS, CD27 or OX-40, onto the first CAR, and the primary signaling domain, e.g., CD3 zeta, on the second CAR can limit the CAR activity to cells where both targets are expressed. In one embodiment, the CAR expressing cell comprises a first cancer associated antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In another aspect, the disclosure features a population of CAR-expressing cells, e.g., CART cells. In some embodiments, the population of CAR-expressing cells comprises a mixture of cells expressing different CARs. For example, in one embodiment, the population of CART cells can include a first cell expressing a CAR having an antigen binding domain to a cancer associated antigen described herein, and a second cell expressing a CAR having a different antigen binding domain, e.g., an antigen binding domain to a different a cancer associated antigen described herein, e.g., an antigen binding domain to a cancer associated antigen described herein that differs from the cancer associate antigen bound by the antigen binding domain of the CAR expressed by the first cell. As another example, the population of CAR-expressing cells can include a first cell expressing a CAR that includes an antigen binding domain to a cancer associated antigen described herein, and a second cell expressing a CAR that includes an antigen binding domain to a target other than a cancer associate antigen as described herein. In one embodiment, the population of CAR-expressing cells includes, e.g., a first cell expressing a CAR that includes a primary intracellular signaling domain, and a second cell expressing a CAR that includes a secondary signaling domain.

In another aspect, the disclosure features a population of cells wherein at least one cell in the population expresses a CAR having an antigen binding domain to a cancer associated antigen described herein, and a second cell expressing another agent, e.g., an agent which enhances the activity of a CAR-expressing cell. For example, in one embodiment, the agent can be an agent which inhibits an inhibitory molecule. Inhibitory molecules, e.g., PD-1, can, in some embodiments, decrease the ability of a CAR-expressing cell to mount an immune effector response. Examples of inhibitory molecules include PD-1, PD-L1, CTLA4, TIM3, CEACAM (CEACAM-1, CEACAM-3, and/or CEACAM-5), LAG3, VISTA, BTLA, TIGIT, LAIR1, CD160, 2B4, CD80, CD86, B7-H3 (CD276), B7-H4 (VTCN1), HVEM (TNFRSF14 or CD270), KIR, A2aR, MHC class I, MHC class II, GALS, adenosine, and TGF (e.g., TGFbeta). In one embodiment, the agent which inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA4, TIM3, CEACAM (CEACAM-1, CEACAM-3, and/or CEACAM-5), LAG3, VISTA, BTLA, TIGIT, LAIR1, CD160, 2B4 and TGF beta, or a fragment of any of these, and a second polypeptide which is an intracellular signaling domain described herein (e.g., comprising a costimulatory domain (e.g., 41BB, CD27, OX40 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28 signaling domain described herein and/or a CD3 zeta signaling domain described herein).

Regulatory Polypeptides of Interest

In some embodiments, the heterologous polypeptide of interest linked to a COF1/CRBN-, COF2/CRBN-, or COF3/CRBN-binding polypeptide and/or a degradation domain is a regulatory protein. Provided herein are regulatory polypeptides and regulatory polypeptide encoding sequences useful in genetic control circuits, cells, and methods for identifying, selecting or making a cell or cell line capable of producing high yields of a product, e.g., a recombinant or therapeutic polypeptide. In general, regulatory polypeptides regulate expression of the product, e.g., a recombinant or therapeutic polypeptide. In some embodiments, the regulatory polypeptide is a gene-editing polypeptide. In some embodiments, the regulatory polypeptide encoding sequence is under the transcriptional control of a control element which activates transcription of the regulatory polypeptide encoding sequence dependent on one or more conditions. In some embodiments, a regulatory polypeptide binds to the control element, e.g., promoter element, operably linked to the recombinant or therapeutic polypeptide encoding sequence. In some embodiments, binding of the regulatory polypeptide to a control element inhibits transcription of the operably linked recombinant or therapeutic polypeptide encoding sequence. In some embodiments, a regulatory polypeptide binds to a sequence encoding an untranslated region of the transcript of the recombinant or therapeutic polypeptide. In some embodiments, binding of the regulatory polypeptide to an untranslated region of the transcript of the recombinant or therapeutic polypeptide inhibits translation of the recombinant or therapeutic polypeptide encoding sequence. In some embodiments, a regulatory polypeptide binds to the coding sequence of the recombinant or therapeutic polypeptide encoding sequence. In some embodiments, binding of the regulatory polypeptide to the coding sequence of the recombinant or therapeutic polypeptide inhibits transcription, translation, or transcription and translation of the recombinant or therapeutic polypeptide encoding sequence.

It is contemplated that the present disclosure is not specific to a particular regulatory polypeptide. Exemplary regulatory polypeptides include but are not limited to: Cas9 molecules, TALE molecules, and zinc finger molecules. In some embodiments, the regulatory polypeptide is a Cas-related protein known in the art. In some embodiments, the regulatory polypeptide is a protein from a type I, II, or III CRISPR/Cas system (e.g. as described in K. S. Makarova et al., Nat. Rev. Microbiol. 9, 467 (2011); K. S. Makarova, N. V. Grishin, S. A. Shabalina, Y. I. Wolf, E. V. Koonin, Biol. Direct 1, 7 (2006); or K. S. Makarova, L. Aravind, Y. I. Wolf, E. V. Koonin, Biol. Direct 6, 38 (2011)).

In some embodiments, the regulatory polypeptide is a Cas9 molecule. Regulatory polypeptides that are Cas9 molecules require one or more (e.g., one, two, three, four or more) suitable gRNAs to inhibit expression of a recombinant or therapeutic polypeptide.

In some embodiments, the regulatory polypeptide is a TALE molecule.

In some embodiments, the regulatory polypeptide is a zinc finger molecule.

In some embodiments, the regulatory polypeptide is an endogenous regulator of the first control element, e.g., the first promoter element. In an embodiment, the endogenous gene encoding the regulatory polypeptide is inactive, e.g., has been knocked out or mutated to produce a loss of function.

Cas9 Molecules and Other Components of the CRISPR/CAS System

In some embodiments, the heterologous polypeptide of interest linked to a COF1/CRBN-, COF2/CRBN-, or COF3/CRBN-binding polypeptide and/or a degradation domain is a Cas9 molecule, a Cas12 molecule, a Cas13 molecule, or another component of the CRISPR/CAS system (e.g., a ribonucleoprotein (RNP) molecule). For gene therapies using the CRISPR/CAS system, one important consideration is to limit side effects caused by the off-target activity of a Cas molecule (e.g., a Cas9 molecule). Fusing a degron, e.g., a COF1/CRBN-, COF2/CRBN-, or COF3/CRBN-binding polypeptide described herein, e.g., the HilD tag or CARB tag described herein, to a component of the CRISPR/CAS system (e.g., a Cas9 molecule or a RNP molecule) helps to generate a gene therapy where the activity of the CRISPR/CAS system can be regulated by a degradation compound described herein, e.g., in the event of side effects.

Cas9 molecules to be used in the genetic control circuits, cells, and methods of the present disclosure may comprise polypeptides originating in a variety of species. In addition, one or more domains from a Cas9 molecule in one species may be combined with one or more domains from a Cas9 molecule in another species, e.g., in a fusion protein. Additional Cas9 polypeptide comprising species include: *Acidovorax avenae, Actinobacillus pleuropneumoniae, Actinobacillus succinogenes, Actinobacillus suis, Actinomyces* sp., *Cycliphilus denitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus puniceispirillum, Clostridium cellulolyticum, Clostridium perfringens, Corynebacterium accolens, Corynebacterium diphtheria, Corynebacterium matruchotii, Dinoroseobacter shibae, Eubacterium dolichum, Gamma proteobacterium, Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria meningitidis, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tistrella mobilis, Treponema* sp., or *Verminephrobacter eiseniae*.

Cas12 molecules (e.g., Cas12a, Cas12b, and Cas12c) have been disclosed, e.g., in Chen et al., Science. 2018 Apr. 27; 360(6387):436-439 and Shmakov et al., Nat Rev Microbiol. 2017 March; 15(3):169-182, herein incorporated by reference in their entireties. CRISPR-Cas12a (Cpf1) proteins are RNA-guided enzymes that bind DNA and generate targeted, double-stranded DNA breaks. Like CRISPR-Cas9, Cas12 is also a useful tool in genome editing. Additional Cas molecules that are useful for gene editing include, but not limited to, Cas13, e.g., Cas13a, Cas13b, and Cas13c, as disclosed in, e.g., WO2017219027 and Shmakov et al., Nat Rev Microbiol. 2017 March; 15(3):169-182, herein incorporated by reference in their entireties. In some embodiments, the heterologous polypeptide of interest is Cas12. In some embodiments, the heterologous polypeptide of interest is Cas13.

Cas9 Structure and Activity

Crystal structures are available for naturally occurring Cas9 polypeptides (Jinek et al., Science, 343(6176): 1247997, 2014) and for *S. pyogenes* Cas9 with a guide RNA (e.g., a synthetic fusion of crRNA and tracrRNA) (Nishimasu et al., Cell, 156:935-949, 2014; and Anders et al., Nature, 2014, doi: 10.1038/nature13579).

In an embodiment, a Cas9 molecule or Cas9 polypeptide comprises one or more of the following domains: a RuvC-like domain and an HNH-like domain. In an embodiment, a Cas9 molecule or Cas9 polypeptide is a dCas9 molecule or dCas9 polypeptide and the dCas9 molecule or dCas9 polypeptide comprises a RuvC-like domain, e.g., a RuvC-like domain that lacks nuclease activity, and/or an HNH-like domain, e.g., an HNH-like domain that lacks nuclease activity.

In an embodiment, the Cas9 molecule or Cas9 polypeptide can include more than one RuvC-like domain (e.g., one, two, three or more RuvC-like domains). In an embodiment, a RuvC-like domain comprises one or more mutations that alter its activity, such that the RuvC domain does not cleave DNA or has reduced DNA cleaving activity. In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

In an embodiment, the Cas9 molecule or Cas9 polypeptide can include more than one HNH-like domain (e.g., one, two, three or more HNH-like domains). In an embodiment, an HNH-like domain comprises one or more mutations that alter its activity, such that the HNH-like domain does not cleave DNA or has reduced DNA cleaving activity. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length.

In embodiments, Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as dCas9 molecules or dCas9 polypeptides. For example, a dCas9 molecule or dCas9 polypeptide can lack cleavage activity or have substantially less, e.g., less than 20, 10, 5, 1 or 0.1% of the cleavage activity of a reference Cas9 molecule or Cas9 polypeptide, as measured by assays known in the art or assays described herein.

Targeting and PAMs

A Cas9 molecule or Cas9 polypeptide is a polypeptide that can interact with a guide RNA (gRNA) molecule and, in concert with the gRNA molecule, localizes to a site which comprises a target domain and PAM sequence.

In an embodiment, the ability of a Cas9 molecule or Cas9 polypeptide to interact with a target nucleic acid is PAM sequence dependent. A PAM sequence is a sequence in the target nucleic acid. Cas9 molecules from different bacterial species can recognize different sequence motifs (e.g., PAM sequences). Cas9 molecules can be engineered to alter the PAM specificity of the Cas9 molecule. Exemplary naturally occurring Cas9 molecules are described in Chylinski et al., RNA BIOLOGY 2013 10:5, 727-737.

Alterations in Cas9 Structure

In some embodiments, one or more mutation(s) can be present, e.g., in one or more RuvC-like domain, e.g., an N-terminal RuvC-like domain; an HNH-like domain; a region outside the RuvC-like domains and the HNH-like domain, of the Cas9 molecule or Cas9 polypeptide. In some embodiments, a mutation(s) is present in a RuvC-like domain, e.g., an N-terminal RuvC-like domain. In some embodiments, a mutation(s) is present in an HNH-like domain. In some embodiments, mutations are present in both a RuvC-like domain, e.g., an N-terminal RuvC-like domain and an HNH-like domain.

In an embodiment, a Cas9 molecule or Cas9 polypeptide, e.g., an dCas9 molecule or dCas9 polypeptide, comprises an amino acid sequence:
  having 60%, 65%, 70%, 75%, 80%, 85%, 90%, 95%, 96%, 97%, 98% or 99% homology with;
  differs at no more than, 2, 5, 10, 15, 20, 30, or 40% of the amino acid residues when compared with;
  differs by at least 1, 2, 5, 10 or 20 amino acids, but by no more than 100, 80, 70, 60, 50, 40 or 30 amino acids from; or
  is identical to any Cas9 molecule sequence described herein, or a naturally occurring Cas9 molecule sequence, e.g., a Cas9 molecule from a species listed herein or described in Chylinski et al., RNA BIOLOGY 2013 10:5, 727-737; Hou et al., PNAS Early Edition 2013, 1-6. In an embodiment, the Cas9 molecule or Cas9 polypeptide comprises one or more of the following activities: a helicase activity; or the ability, together with a gRNA molecule, to localize to a target nucleic acid. In an embodiment, the Cas9 molecule or Cas9 polypeptide does not comprise a nickase activity or a double stranded cleavage activity (e.g., an endonuclease and/or exonuclease activity).

Exemplary mutations that may be made in the RuvC domain or HNH domain with reference to the S. pyogenes sequence include: D10A, E762A, H840A, N854A, N863A and/or D986A.

Exemplary Cas9 polypeptide and Cas9 domain sequences can be found in Tables 50-54 of WO2015/157070.

dCas9 Polypeptides

In an embodiment, the heterologous polypeptide of interest linked to a COF1/CRBN-, COF2/CRBN-, or COF3/CRBN-binding polypeptide and/or a degradation domain is a dCas9 molecule, e.g., a dCas9 polypeptide comprising one or more differences in a RuvC domain and/or in an HNH domain as compared to a reference Cas9 molecule, and the dCas9 molecule or dCas9 polypeptide does not cleave a nucleic acid, or cleaves with significantly less efficiency than does wildtype, e.g., when compared with wild type in a cleavage assay, e.g., as described herein, cuts with less than 50, 25, 10, or 1% of a reference Cas9 molecule, as measured by an assay described herein.

Mutating key residues in both DNA cleavage domains of the Cas9 protein (e.g. the D10A and H840A mutations) results in the generation of a catalytically inactive Cas9 (dCas9 which is also known as dead Cas9) molecule. An enzymatically inactive Cas9, e.g., dCas9, complexes with a gRNA and localizes to the DNA sequence specified by that gRNA's targeting domain; however, it does not cleave the target DNA. An enzymatically inactive (e.g., dCas9) Cas9 molecule can block transcription when recruited to early regions in the coding sequence. Additional repression can be achieved by fusing a transcriptional repression domain (for example KRAB, SID or ERD) to the enzymatically inactive Cas9, e.g., dCas9, and recruiting it to the target sequence, e.g., within 1000 bp of sequence 3' of the start codon or within 500 bp of a control element, e.g., promoter element, e.g., 5' of the start codon of a gene. Targeting DNase I hypersensitive sites (DHSs) of the promoter (e.g., by making gRNAs complementary to the DHSs) may be an additional strategy for gene repression, e.g., inhibition of a recombinant or therapeutic polypeptide encoding sequence, because these regions are more likely to be accessible to the enzymatically inactive Cas9, e.g., dCas9, and are also likely to harbor sites for endogenous transcription factors. While not wishing to be bound by theory, it is contemplated herein that blocking the binding site of an endogenous transcription factor or RNA polymerase would aid in down-regulating gene expression, e.g., expression of a recombinant or therapeutic polypeptide encoding sequence. In an embodiment, one or more enzymatically inactive Cas9, e.g., dCas9, molecules may be used to block binding of one or more endogenous transcription factors. In another embodiment, an enzymatically inactive Cas9, e.g., dCas9, molecule can be fused to an effector domain, e.g., a repression domain, an activation domain, a methylation enzyme, etc. Fusion of the enzymatically inactive Cas9, e.g., dCas9, to an effector domain enables recruitment of the effector to any DNA site specified by the gRNA. Altering chromatin status can result in decreased expression of the target gene. One or more enzymatically inactive Cas9, e.g., dCas9, molecules fused to one or more chromatin modifying proteins may be used to alter chromatin status.

In an embodiment, a gRNA molecule can be targeted to a control element (e.g., promoter element), e.g., the control element operably linked to a recombinant or therapeutic polypeptide encoding sequence. In an embodiment a gRNA molecule can be targeted to a sequence encoding a recombinant or therapeutic polypeptide.

TALE Molecules

In some embodiments, the heterologous polypeptide of interest linked to a COF1/CRBN-, COF2/CRBN-, or COF3/CRBN-binding polypeptide and/or a degradation domain is a transcription activator-like effector (TALE) molecule or TALE polypeptide. A molecule or TALE polypeptide, as that term is used herein, refers to a molecule or polypeptide comprising multiple TALE DNA-binding repeat domains (TALE DBDs) that can home or localize to a nucleic acid position specified by the TALE DBDs. TALE molecule and TALE polypeptide, as those terms are used herein, refer to naturally occurring TALE molecules and to engineered, altered, or modified TALE molecules or TALE polypeptides that differ, e.g., by at least one amino acid residue, from a reference sequence, e.g., the most similar naturally occurring TALE molecule known in the art.

TALE DBD, as that term is used herein, refers to a 33-35 amino acid motif, including two hypervariable residues (i.e. a repeat variable di-residue, RVD) at positions 12 and 13 of the motif. The RVD of a TALE DNA-binding domain (DBD) specifies the DNA base-pair or base-pairs to which a TALE DBD has binding affinity. When TALE DBDs are combined in arrays within a TALE molecule or TALE polypeptide, the order of TALE DBDs (and their RVD) determine the DNA sequence to which a TALE molecule or TALE polypeptide has binding affinity. Naturally occurring TALE polypeptides and TALE DBDs are produced by *Xanthomonas* bacteria.

Repeat variable di-residue (RVD), as that term is used herein, refers to the two hypervariable amino acid residues at positions 12 and 13 of a TALE DBD. The RVD determines the DNA base-pair affinity of a TALE DBD. All possible combinations of RVDs and their respective base-pair affinities are known in the art. See, e.g., Cong L., et al. Nat Commun. 2012 Jul. 24; (3):968; Juillerat A., et al. Sci Rep. 2015 Jan. 30; 50:8150; Miller J. C. et al. Nat Methods 12, 465-471 (2015); Streubel J., et al. Nat Biotechnol 30, 593-595 (2012); and Yang J. et al. Cell Res 24, 628-631 (2014), incorporated herein by reference in their entireties. All possible RVDs are contemplated for use with the repressor polypeptides, e.g., TALE molecules, described herein.

TALE DBD array, as that term is used herein, refers to the identities and order of TALE DBDs, e.g., the RVDs of each TALE DBD, within a TALE molecule or TALE polypeptide. The TALE DBD array determines the sequence specific binding affinity of a TALE molecule or TALE polypeptide.

In some embodiments, the repressor polypeptide is a TALE molecule or TALE polypeptide. TALE DBDs and TALE polypeptide from any species of *Xanthomonas* can be used in the genetic control circuits, cells, and methods for identifying, selecting, or making a cell or cell line capable of producing high yields of a product, e.g., a recombinant or therapeutic polypeptide, described herein. In some embodiments, the repressor polypeptide is a naturally occurring TALE molecule or TALE polypeptide. In some embodiments, the repressor polypeptide is an engineered TALE molecule or TALE polypeptide, i.e. a TALE molecule or TALE polypeptide that differs by one or more amino acids from a naturally occurring TALE molecule or TALE polypeptide or from another engineered TALE molecule or TALE polypeptide known in the art.

In some embodiments, an engineered TALE molecule or TALE polypeptide comprises an amino acid sequence:
- having 60%, 65%, 70%, 75%, 80%, 85%, 90%, 95%, 96%, 97%, 98% or 99% homology with;
- differs at no more than, 2, 5, 10, 15, 20, 30, or 40% of the amino acid residues when compared with;
- differs by at least 1, 2, 5, 10 or 20 amino acids, but by no more than 100, 80, 70, 60, 50, 40 or 30 amino acids from; or
- is identical to any TALE molecule sequence described herein, or a naturally occurring TALE molecule sequence, e.g., a TALE molecule from a species listed herein or described in a publication referenced herein.

In some embodiments, a TALE molecule localizes to the target DNA sequence specified by that TALE molecules' TALE DBD array. In some embodiments, TALE molecule can block transcription when recruited to early regions in a coding sequence, e.g., the coding sequence of a recombinant or therapeutic polypeptide. In some embodiments, a TALE molecule can block transcription when recruited to a control element, e.g., a promoter element, operably linked to a recombinant or therapeutic polypeptide encoding sequence. In some embodiments, additional repression can be achieved by fusing a transcriptional repression domain (for example KRAB, SID or ERD) to the TALE molecule, enabling recruitment of the effector to any DNA site specified by the TALE DBD array.

In some embodiments, a TALE molecule comprises two or more (e.g. 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more) TALE DBDs.

In some embodiments, the TALE DBD array of a repressor polypeptide, e.g., TALE molecule, specifies a target DNA sequence. In some embodiments, the target sequence specified by the TALE DBD array is comprised within a control element, e.g., promoter element, operably linked to a recombinant or therapeutic polypeptide encoding sequence. In some embodiments, the target sequence specified by the TALE DBD array is comprised with a recombinant or therapeutic polypeptide encoding sequence.

Exemplary naturally occurring and engineered TALE polypeptide sequences and methods for design and testing of TALE polypeptides for use with genetic control circuits, cells, and methods for identifying, selecting, or making a cell or cell line capable of producing high yields of a product, e.g., a recombinant or therapeutic polypeptide, described herein can be found in the art, e.g., in Zhang F, et al. Nat Biotechnol. 2011; 29:149-153; Geissler R, et al. PLoS One. 2011; 6:e19509; Garg A, et al. Nucleic Acids Res. 2012; Bultmann S, et al. Nucleic Acids Res. 2012; 40:5368-5377; Cermak T, et al. Efficient design and assembly of custom TALEN and other TAL effector-based constructs for DNA targeting. Nucleic Acids Res. 2011; 39:e82; Cong L, et al. Nat Commun. 2012; 3:968; and Miller J C, et al. Nat Biotechnol. 2011; 29:143-148, herein incorporated by reference in their entireties.

Zinc Finger Molecules

In some embodiments, the heterologous polypeptide of interest linked to a COF1/CRBN-, COF2/CRBN-, or COF3/CRBN-binding polypeptide and/or a degradation domain is a zinc finger molecule. A zinc finger molecule, as that term is used herein, refers to a molecule or polypeptide comprising multiple zinc finger domains (ZFDs). A zinc finger molecule has affinity to a specific DNA sequence determined by the identity and order of the ZFDs the zinc finger molecule comprises.

A zinc finger domain (ZFD), as that term is used herein, refers to any of a family of polypeptides that bind DNA in a sequence specific manner and require a zinc ion ligand to bind DNA. Many families of ZFDs have been studied and characterized (see, e.g., Krishna, S S., et al. Nucl. Acids Res. (2003) 31 (2): 532-550). The disclosure contemplates zinc finger molecules that may comprise ZFDs of any type or origin known to those of skill in the art. Without intending to be limited to any particular type of ZFD, the disclosure contemplates zinc finger molecules comprising $Cys_2His_2$ ZFDs, which are the most prevalent and well-studied ZFDs in the art. $Cys_2His_2$ ZFDs comprise two beta strands that form an anti-parallel beta sheet and an alpha helix. Positions −1, 1, 2, 3, 5, and 6 of the alpha helix are known to specify DNA sequence specific binding by interacting with DNA base pairs. In an embodiment, a $Cys_2His_2$ ZFD may have specific binding affinity for a 3 base pair target sequence. In an embodiment, a $Cys_2His_2$ZFD may specifically interact with an additional base pair adjacent to the target sequence in a context specific manner, i.e. dependent upon the presence and identity of adjacent ZFDs within a zinc finger molecule.

A zinc finger domain array, or ZFD array, as that term is used herein, refers to the identities and order of ZFDs, within a zinc finger molecule or zinc finger polypeptide. The ZFD array determines the sequence specific binding affinity of a zinc finger molecule or zinc finger polypeptide.

In some embodiments, the repressor polypeptide is a zinc finger molecule or zinc finger polypeptide. ZFDs and zinc finger polypeptides from any species (e.g., a mammalian species, e.g., humans) can be used in the genetic control circuits, cells, and methods for identifying, selecting, or making a cell or cell line capable of producing high yields of a product, e.g., a recombinant or therapeutic polypeptide, described herein. In some embodiments, the repressor polypeptide is a naturally occurring zinc finger molecule or zinc finger polypeptide. In some embodiments, the repressor polypeptide is an engineered zinc finger molecule or zinc finger polypeptide, i.e. a zinc finger molecule or zinc finger polypeptide that differs by one or more amino acids from a naturally occurring zinc finger molecule or zinc finger polypeptide or from another engineered zinc finger molecule or zinc finger polypeptide known in the art.

In some embodiments, an engineered zinc finger molecule or zinc finger polypeptide comprises an amino acid sequence:
having 60%, 65%, 70%, 75%, 80%, 85%, 90%, 95%, 96%, 97%, 98% or 99% homology with;
differs at no more than, 2, 5, 10, 15, 20, 30, or 40% of the amino acid residues when compared with;
differs by at least 1, 2, 5, 10 or 20 amino acids, but by no more than 100, 80, 70, 60, 50, 40 or 30 amino acids from; or
is identical to any zinc finger molecule sequence described herein, or a naturally occurring zinc finger molecule sequence, e.g., a zinc finger molecule from a species listed herein or described in a publication referenced herein.

In some embodiments, a zinc finger molecule localizes to the target DNA sequence specified by that zinc finger molecules' ZFD array. In some embodiments, a zinc finger molecule can block transcription when recruited to early regions in a coding sequence, e.g., the coding sequence of a recombinant or therapeutic polypeptide. In some embodiments, a zinc finger molecule can block transcription when recruited to a control element, e.g., a promoter element, operably linked to a recombinant or therapeutic polypeptide encoding sequence. In some embodiments, additional repression can be achieved by fusing a transcriptional repression domain (for example KRAB, SID or ERD) to the zinc finger molecule, enabling recruitment of the effector to any DNA site specified by the ZFD array.

In some embodiments, a zinc finger molecule comprises two or more (e.g. 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more) ZFDs. In some embodiments, a ZFD array can be constructed from ZFDs with known target sequence affinities to create a zinc finger molecule or zinc finger polypeptide with a desired specific target sequence.

In some embodiments, the ZFD array of a repressor polypeptide, e.g., zinc finger molecule, specifies a target DNA sequence. In some embodiments, the target sequence specified by the ZFD array is comprised within a control element, e.g., promoter element, operably linked to a recombinant or therapeutic polypeptide encoding sequence. In some embodiments, the target sequence specified by the ZFD array is comprised with a recombinant or therapeutic polypeptide encoding sequence.

Exemplary naturally occurring and engineered zinc finger polypeptide sequences and methods for design and testing of zinc finger polypeptides for use with genetic control circuits, cells, and methods for identifying, selecting, or making a cell or cell line capable of producing high yields of a product, e.g., a recombinant or therapeutic polypeptide, described herein can be found in the art, e.g., in Wolfe S A, et al. Annu Rev Biophys Biomol Struct. 2000; 29:183-212; Pabo C O, et al. Annu Rev Biochem. 2001; 70:313-340; Greisman H A, Pabo C O. Science. 1997; 275:657-661; Isalan M, et al., Proc Natl Acad Sci USA. 1997; 94:5617-5621; Wolfe S A, et al. J Mol Biol. 1999; 285:1917-1934, herein incorporated by reference in their entireties.

Methods of designing ZFDs and ZFD arrays to bind specific target DNA sequences can be found in the art, e.g., in Maeder M L, et al. Mol Cell. 2008; 31:294-301; Sander J D, et al., Nat Methods. 2011; 8:67-69; and Meng X, et al. Nat Biotechnol. 2008; 26:695-701, herein incorporated by reference in their entireties.

Degradation Domains

In some embodiments, the fusion polypeptide of this invention further comprises a degradation domain. In some embodiments, the degradation domain has a first state and a second state, e.g., states of stabilization/destabilization, or states of folding/misfolding. The first state is associated with, causes, or mediates expression of the fusion polypeptide at a first rate or level and the second state is associated with, causes, or mediates expression of the fusion polypeptide at a second rate or level. In some embodiments, the second state has a level or rate that is greater, e.g., 2, 3, 4, 5, 6, 7, 8, 9, 10, 20, or 30 fold greater, than the rate or level of the first state. In some embodiments, the second state is associated with, maintained by, or caused by the presence of a stabilization compound. In some embodiments, the presence of the stabilization compound can be associated with, cause, or mediate the transformation of a first folding state to a second folding state, e.g., from misfolded to more properly folded state, e.g., a first state susceptible to degradation to a second state less susceptible to degradation than the first state; or from a first folding state that has a first level of degradation to a second folding state what has a second, lessor, level of degradation, e.g., in a cell of interest.

In an embodiment, addition of a stabilization compound to a plurality of cells, e.g., host cells or cells comprising fusion polypeptides described herein, causes a transformation of a sub-plurality of cells from the first state to the second state, e.g., states of stabilization/destabilization, or states of folding/misfolding as described herein. In an embodiment, in the absence of the stabilization compound, less than 10, 9, 8, 7, 6, 5, 4, 3, 2, or 1% of the cells in the plurality comprise the second state, and greater than or equal to 90, 91, 92, 93, 94, 95, 96, 97, 98, or 99% of the cells in the plurality comprise the first state. In an embodiment, in the presence of the stabilization compound, greater than or equal to 20, 30, 40, 50, 60, 70, 80, 90, or 95% of the cells in the plurality comprise the second state, and less than 20, 15, 10, 9, 8, 7, 6, 5, 4, 3, 2, or 1% of the cells in the plurality comprise the first state. Determination of the percentages of cells in a plurality comprising a state can be made using methods described throughout the specification.

In one embodiment, the degradation domain is separated from the rest of the fusion polypeptide by a heterologous protease cleavage site.

Without wishing to be bound by theory, in some embodiments, the degradation domain is unstable and/or unable to fold into a stable conformation in the absence of a stabilization compound. This misfolded/unfolded degradation domain can be degraded by intracellular degradation pathway along with the rest of the fusion polypeptide. In the presence of the stabilization compound, the degradation domain assumes a proper conformation and is less susceptible to intercellular degradation pathways. Thus, the expression level of the fusion polypeptide can be regulated by the presence or absence of the stabilization compound.

In some embodiments, the proper folding of the degradation domain exposes the heterologous protease cleavage site, leading to the cleavage of the heterologous protease cleavage site and the removal of the degradation domain from the rest of the fusion polypeptide.

Methods of generating degradation domains that are selectively stable in the presence of a stabilization compound are well known in the art and discussed further below. Several such domain-stabilization compound pairs have been generated to date and are featured in the present invention. These include degradation domains based on FKBP (e.g., using a "Shield" stabilization compound) as described in: A Rapid, Reversible, and Tunable Method to Regulate Protein Function in Living Cells Using Synthetic Small Molecules." Banaszynski, L. A.; Chen, L.-C.; Maynard-Smith, L. A.; Ooi, A. G. L.; Wandless, T. J. Cell, 2006, 126, 995-1004; domains based on DHFR (e.g., using trimethoprim as a stabilization compound) as described in A general chemical method to regulate protein stability in the mammalian central nervous system. Iwamoto, M.; Björklund, T.; Lundberg, C.; Kirik, D.; Wandless, T. J. Chemistry & Biology, 2010, 17, 981-988; and domains based on estrogen receptor alpha (e.g., where 4OHT is used as a stabilization compound) as described in Destabilizing domains derived from the human estrogen receptor Y Miyazaki, H Imoto, L-c Chen, T J Wandless J. Am. Chem. Soc. 2012, 134, 3942-3945. Each of these references is incorporated by reference in its entirety.

The present disclosure encompasses degradation domains derived from any naturally occurring protein. Preferably, fusion polypeptides of the invention will include a degradation domain for which there is no ligand natively expressed in the cell compartments of interest. For example, if the fusion polypeptide is designed for expression in T cells, it is preferable to select a degradation domain for which there is no naturally occurring ligand present in T cells. Thus, the degradation domain, when expressed in the cell of interest, will only be stabilized in the presence of an exogenously added compound. Notably, this property can be engineered by either engineering the degradation domain to no longer bind a natively expressed ligand (in which case the degradation domain will only be stable in the presence of a synthetic compound) or by expressing the degradation domain in a compartment where the natively expressed ligand does not occur (e.g., the degradation domain can be derived from a species other than the species in which the fusion polypeptide will be expressed).

Degradation domain-stabilization compound pairs can be derived from any naturally occurring or synthetically developed protein. Stabilization compounds can be any naturally occurring or synthetic compounds. In certain embodiments, the stabilization compounds will be existing prescription or over-the-counter medicines. Examples of proteins that can be engineered to possess the properties of a degradation domain are set forth in Table 21 below along with a corresponding stabilization compound.

In some embodiments, the degradation domain is derived from a protein listed in Table 21.

In some embodiments, the degradation domain is derived from an estrogen receptor (ER). In some embodiments, the degradation domain comprises an amino acid sequence selected from SEQ ID NO: 46 or a sequence having at least 90%, 95%, 97%, 98%, or 99% identity thereto, or SEQ ID NO: 48 or a sequence having at least 90%, 95%, 97%, 98%, or 99% identity thereto. In some embodiments, the degradation domain comprises the amino acid sequence of SEQ ID NO: 46 or 48. When the degradation domain is derived from an estrogen receptor, the stabilization compound can be selected from Bazedoxifene or 4-hydroxy tamoxifen (4-OHT). In some embodiments, the stabilization compound is Bazedoxifene. Tamoxifen and Bazedoxifene are FDA approved drugs, and thus are safe to use in human.

In some embodiments, the degradation domain is derived from an FKB protein (FKBP). In some embodiments, the degradation domain comprises the amino acid sequence of SEQ ID NO: 50 or a sequence having at least 90%, 95%, 97%, 98%, or 99% identity thereto. In some embodiments, the degradation domain comprises the amino acid sequence of SEQ ID NO: 50. When the degradation domain is derived from a FKBP, the stabilization compound can be Shield-1.

In some embodiments, the degradation domain is derived from dihydrofolate reductase (DHFR). In some embodiments, the degradation domain comprises the amino acid sequence of SEQ ID NO: 51 or a sequence having at least 90%, 95%, 97%, 98%, or 99% identity thereto. In some embodiments, the degradation domain comprises the amino acid sequence of SEQ ID NO: 51. When the degradation domain is derived from a DHFR, the stabilization compound can be Trimethoprim.

In some embodiments, the degradation domain is not derived from an FKB protein, estrogen receptor, or DHFR.

TABLE 21

Exemplary proteins for generating degradation domains

| Type | Activity of drug | Drug examples |
|---|---|---|
| Oxidoreductases | | |
| Aldehyde dehydrogenase | Inhibitor | Disulfiram |
| Monoamine oxidases (MAOs) | MAO-A inhibitor | Tranylcypromine, moclobemide |
| | MAO-B inhibitor | Tranylcypromine |
| Cyclooxygenases (COXs) | COX1 inhibitor | Acetylsalicylic acid, profens, acetaminophen and dipyrone (as arachidonylamides) |
| | COX2 inhibitor | Acetylsalicylic acid, profens, acetaminophen and dipyrone (as arachidonylamides) |
| Vitamin K epoxide reductase | Inhibitor | Warfarin, phenprocoumon |
| Aromatase | Inhibitor | Exemestane |
| Lanosterol demethylase (fungal) | Inhibitor | Azole antifungals |
| Lipoxygenases | Inhibitor | Mesalazine |
| | 5-lipoxygenase inhibitor | Zileuton |
| Thyroidal peroxidase | Inhibitor | Thiouracils |
| Iodothyronine-5' deiodinase | Inhibitor | Propylthiouracil |
| Inosine monophosphate dehydrogenase | Inhibitor | Mycophenolate mofetil |
| HMG-CoA reductase | Inhibitor | Statins |
| (α-5-Testosterone reductase | Inhibitor | Finasteride, dutasteride |
| Dihydrofolate reductase (bacterial) | Inhibitor | Trimethoprim |
| Dihydrofolate reductase (human) | Inhibitor | Methotrexate, pemetrexed |
| Dihydrofolate reductase (parasitic) | Inhibitor | Proguanil |
| Dihydroorotate reductase | Inhibitor | Leflunomide |
| Enoyl reductase (mycobacterial) | Inhibitor | Isoniazid |
| Squalene epoxidase (fungal) | Inhibitor | Terbinafin |
| Δ-14 reductase (fungal) | Inhibitor | Amorolfin |
| Xanthine oxidase | Inhibitor | Allopurinol |
| 4-Hydroxyphenylpyruvate dioxygenase | Inhibitor | Nitisinone |
| Ribonucleoside diphosphate reductase | Inhibitor | Hydroxycarbamide |
| Transferases | | |
| Protein kinase C | Inhibitor | Miltefosine |
| Bacterial peptidyl transferase | Inhibitor | Chloramphenicol |
| Catecholamine-O-methyltransferase | Inhibitor | Entacapone |
| RNA polymerase (bacterial) | Inhibitor | Ansamycins |
| Reverse transcriptases (viral) | Competitive inhibitors | Zidovudine |
| | Allosteric inhibitors | Efavirenz |
| DNA polymerases | Inhibitor | Acyclovir, suramin |
| GABA transaminase | Inhibitor | Valproic acid, vigabatrin |
| Tyrosine kinases | PDGFR/ABL/KIT inhibitor | Imatinib |
| | EGFR inhibitor | Erlotinib |
| | 3-VEGFR2/PDGFR/KIT/FLT3 | Sunitinib |
| | 3-VEGFR2/PDGFR/RAF | Sorafenib |
| Glycinamide ribonucleotide formyl transferase | Inhibitor | Pemetrexed |
| Phosphoenolpyruvate transferase (MurA, bacterial) | Inhibitor | Fosfomycin |
| Human cytosolic branched-chain aminotransferase (hBCATc) | Inhibitor | Gabapentin |
| Hydrolases (proteases) | | |
| Aspartyl proteases (viral) | HIV protease inhibitor | Saquinavir, indinavir |
| Hydrolases (serine proteases) | | |
| Unspecific | Unspecific inhibitors | Aprotinine |
| Bacterial serine protease | Direct inhibitor | β-lactams |
| Bacterial serine protease | Indirect inhibitor | Glycopeptides |
| Bacterial lactamases | Direct inhibitor | Sulbactam |
| Human antithrombin | Activator | Heparins |
| Human plasminogen | Activator | Streptokinase |
| Human coagulation factor | Activator | Factor IX complex, Factor VIII |
| Human factor Xa | Inhibitor | Fondaparinux |

TABLE 21-continued

| Exemplary proteins for generating degradation domains | | |
|---|---|---|
| Hydrolases (metalloproteases) | | |
| Human ACE | Inhibitor | Captopril |
| Human HRD | Inhibitor | Cilastatin |
| Human carboxypeptidase A (Zn) | Inhibitor | Penicillamine |
| Human enkephalinase | Inhibitor | Racecadotril |
| Hydrolases (other) | | |
| 26S proteasome | Inhibitor | Bortezomib |
| Esterases | AChE inhibitor | Physostigmine |
| | AChE reactivators | Obidoxime |
| | PDE inhibitor | Caffeine |
| | PDE3 inhibitor | Amrinon, milrinone |
| | PDE4 inhibitor | Papaverine |
| | PDE5 inhibitor | Sildenafil |
| | HDAC inhibitor | Valproic acid |
| | HDAC3/HDAC7 inhibitor | Carbamezepine |
| Glycosidases (viral) | α-glycosidase inhibitor | Zanamivir, oseltamivir |
| Glycosidases (human) | α-glycosidase inhibitor | Acarbose |
| Lipases | Gastrointestinal lipases inhibitor | Orlistat |
| Phosphatases | Calcineurin inhibitor | Cyclosporin |
| | Inositol polyphosphate phosphatase inhibitor | Lithium ions |
| GTPases | Rac1 inhibitor | 6-Thio-GTP (azathioprine metabolite) |
| Phosphorylases | Bacterial C55-lipid phosphate dephosphorylase inhibitor | Bacitracin |
| Lyases | | |
| DOPA decarboxylase | Inhibitor | Carbidopa |
| Carbonic anhydrase | Inhibitor | Acetazolamide |
| Histidine decarboxylase | Inhibitor | Tritoqualine |
| Ornithine decarboxylase | Inhibitor | Eflornithine |
| Soluble guanylyl cyclase | Activator | Nitric acid esters, molsidomine |
| Isomerases | | |
| Alanine racemase | Inhibitor | D-Cycloserine |
| DNA gyrases (bacterial) | Inhibitor | Fluoroquinolones |
| Topoisomerases | Topoisomerase I inhibitor | Irinotecan |
| | Topoisomerase II inhibitor | Etoposide |
| 8,7 isomerase (fungal) | Inhibitor | Amorolfin |
| Ligases (also known as synthases) | | |
| Dihydropteroate synthase | Inhibitor | Sulphonamides |
| Thymidylate synthase (fungal and human) | Inhibitor | Fluorouracil |
| Thymidylate synthase (human) | Inhibitor | Methotrexate, pemetrexed |
| Phosphofructokinase | Inhibitor | Antimony compounds |
| mTOR | Inhibitor | Rapamycin |
| Haem polymerase (Plasmodium) | Inhibitor | Quinoline antimalarials |
| β-1,3--D-glucansynthase (fungi) | Inhibitor | Caspofungin |
| Glucosylceramide synthase | Inhibitor | Miglustat |

| Substrate | Drug substance |
|---|---|
| Asparagine | Asparaginase |
| Urate | Rasburicase (a urate oxidase) |
| VAMP-synaptobrevin, SNAP25, Syntaxin | Light chain of the botulinum neurotoxin (Zn-endopeptidase) |

| Type | Activity of drug | Drug examples |
|---|---|---|
| Direct ligand-gated ion channel receptors | | |
| $GABA_A$ receptors | Barbiturate binding site agonists | Barbiturate |
| | Benzodiazepine binding site agonists | Benzodiazepines |
| | Benzodiazepine binding site antagonists | Flumazenil |
| Acetylcholine receptors | Nicotinic receptor agonists | Pyrantel (of *Angiostrongylus*), levamisole |
| | Nicotinic receptor stabilizing antagonists | Alcuronium |

TABLE 21-continued

| Exemplary proteins for generating degradation domains | | |
|---|---|---|
| | Nicotinic receptor depolarizing antagonists | Suxamethonium |
| | Nicotinic receptor allosteric modulators | Galantamine |
| Glutamate receptors (ionotropic) | NMDA subtype antagonists | Memantine |
| | NMDA subtype expression modulators | Acamprosate |
| | NMDA subtype phencyclidine binding site antagonists | Ketamine |
| G-protein-coupled receptors | | |
| Acetylcholine receptors | Muscarinic receptor agonists | Pilocarpine |
| | Muscarinic receptor antagonists | Tropane derivatives |
| | Muscarinic receptor $M_3$ antagonists | Darifenacine |
| Adenosine receptors | Agonists | Adenosine |
| | Adenosine $A_1$ receptor agonists | Lignans from valerian |
| | Adenosine A1 receptor antagonists | Caffeine, theophylline |
| | Adenosine $A_{2A}$ receptor antagonists | Caffeine, theophylline |
| Adrenoceptors | Agonists | Adrenaline, noradrenaline, ephedrine |
| | $\alpha_1$- and $\alpha_2$-receptors agonists | Xylometazoline |
| | $\alpha_1$-receptor antagonists | Ergotamine |
| | $\alpha_2$-receptor, central agonists | Methyldopa (as methylnoradrenaline) |
| | $\beta$-adrenoceptor antagonists | Isoprenaline |
| | $\beta_1$-receptor antagonists | Propranolol, atenolol |
| | $\beta_2$-receptor agonists | Salbutamol |
| | $\beta_2$-receptor antagonists | Propranolol |
| Angiotensin receptors | $AT_1$-receptors antagonists | Sartans |
| Calcium-sensing receptor | Agonists | Strontium ions |
| | Allosteric activators | Cinacalcet |
| Cannabinoid receptors | $CB_1$- and $CB_2$-receptors agonists | Dronabinol |
| Cysteinyl-leukotriene receptors | Antagonists | Montelukast |
| Dopamine receptors | Dopamine receptor subtype direct agonists | Dopamine, levodopa |
| | $D_2$, $D_3$ and $D_4$ agonists | Apomorphine |
| | $D_2$, $D_3$ and $D_4$ antagonists | Chlorpromazine, fluphenazine, haloperidol, metoclopramide, ziprasidone |
| Endothelin receptors ($ET_A$, $ET_B$) | Antagonists | Bosentan |
| GAB $A_B$ receptors | Agonists | Baclofen |
| Glucagon receptors | Agonists | Glucagon |
| Glucagon-like peptide-1 receptor | Agonists | Exenatide |
| Histamine receptors | $H_1$-antagonists | Diphenhydramine |
| | $H_2$-antagonists | Cimetidine |
| Opioid receptors | μ-opioid agonists | Morphine, buprenorphine |
| | μ-, κ- and δ-opioid antagonists | Naltrexone |
| | κ-opioid antagonists | Buprenorphine |
| Neurokinin receptors | $NK_1$ receptor antagonists | Aprepitant |
| Prostanoid receptors | Agonists | Misoprostol, sulprostone, iloprost |
| Prostamide receptors | Agonists | Bimatoprost |
| Purinergic receptors | $P_2Y_{12}$ antagonists | Clopidogrel |
| Serotonin receptors | Subtype-specific (partial) agonists | Ergometrine, ergotamine |
| | 5-$HT_{1A}$ partial agonists | Buspirone |
| | 5-$HT_{1B/1D}$ agonists | Triptans |
| | 5-$HT_{2A}$ antagonists | Quetiapine, ziprasidone |
| | 5-$HT_3$ antagonists | Granisetron |
| | 5-$HT_4$ partial agonists | Tegaserode |
| Vasopressin receptors | Agonists | Vasopressin |
| | $V_1$ agonists | Terlipressin |
| | $V_2$ agonists | Desmopressin |
| | OT agonists | Oxytocin |
| | OT antagonists | Atosiban |
| Cytokine receptors | | |
| Class I cytokine receptors | Growth hormone receptor antagonists | Pegvisomant |
| | Erythropoietin receptor agonists | Erythropoietin |

TABLE 21-continued

| Exemplary proteins for generating degradation domains | | |
|---|---|---|
| | Granulocyte colony stimulating factor agonists | Filgrastim |
| | Granulocyte-macrophage colony stimulating factor agonists | Molgramostim |
| | Interleukin-1 receptor antagonists | Anakinra |
| | Interleukin-2 receptor agonists | Aldesleukin |
| TNFα receptors | Mimetics (soluble) | Etanercept |
| Integrin receptors | | |
| Glycoprotein IIb/IIIa receptor | Antagonists | Tirofiban |
| Receptors associated with a tyrosine kinase | | |
| Insulin receptor | Direct agonists | Insulin |
| Insulin receptor | Sensitizers | Biguanides |
| Nuclear receptors (steroid hormone receptors) | | |
| Mineralocorticoid receptor | Agonists | Aldosterone |
| | Antagonists | Spironolactone |
| Glucocorticoid receptor | Agonists | Glucocorticoids |
| Progesterone receptor | Agonists | Gestagens |
| Estrogen receptor | Agonists | Oestrogens |
| | (Partial) antagonists | Clomifene |
| | Antagonists | Fulvestrant |
| | Modulators | Tamoxifen, raloxifene |
| | Androgen receptor Agonists | Testosterone |
| | Antagonists | Cyproterone acetate |
| Vitamin D receptor | Agonists | Retinoids |
| ACTH receptor agonists | Agonists | Tetracosactide (also known as cosyntropin) |
| Nuclear receptors (other) | | |
| | α-Retinoic acid receptors RAR agonists | Isotretinoin |
| | β-RAR agonists | Adapalene, isotretinoin |
| | γ-RAR agonists | Adapalene, isotretinoin |
| Peroxisome proliferator-activated receptor (PPAR) | α-PPAR agonists | Fibrates |
| | γ-PPAR agonists | Glitazones |
| Thyroid hormone receptors | Agonists | L-Thyroxine |
| Voltage-gated $Ca^{2+}$ channels | | |
| General | Inhibitor | Oxcarbazepine |
| In Schistosoma sp. | Inhibitor | Praziquantel |
| L-type channels | Inhibitor | Dihydropyridines, diltiazem, lercanidipine, pregabalin, verapamil |
| T-type channels | Inhibitor | Succinimides |
| K+ channels | | |
| Epithelial $K^+$ channels | Opener Inhibitor | Diazoxide, minoxidil Nateglinide, sulphonylureas |
| Voltage-gated $K^+$ channels | Inhibitor | Amiodarone |
| $Na^+$ channels | | |
| Epithelial Na+ channels (ENaC) | Inhibitor | Amiloride, bupivacaine, lidocaine, procainamide, quinidine |
| Voltage-gated $Na^+$ channels | Inhibitor | Carbamazepine, flecainide, lamotrigine, phenytoin, propafenone, topiramate, valproic acid |
| Ryanodine-inositol 1,4,5-triphosphate receptor $Ca^{2+}$ channel (RIR-CaC) family | | |
| Ryanodine receptors | Inhibitor | Dantrolene |
| Transient receptor potential $Ca^{2+}$ channel (TRP-CC) family | | |
| TRPV1 receptors | Inhibitor | Acetaminophen (as arachidonylamide) |
| Cl- channels | | |
| Cl⁻ channel | Inhibitor (mast cells) Opener (parasites) | Cromolyn sodium Ivermectin |
| Cation-chloride cotransporter (CCC) family | Thiazide-sensitive NaCl symporter, human inhibitor | Thiazide diuretics |
| | Bumetanide-sensitive NaCl/KCl symporters, human inhibitor | Furosemide |

TABLE 21-continued

Exemplary proteins for generating degradation domains

| | | |
|---|---|---|
| Na+/H+ antiporters | Inhibitor | Amiloride, triamterene |
| Proton pumps | $Ca^{2+}$-dependent ATPase (PfATP6; Plasmodia) inhibitor | Artemisinin and derivatives |
| H+/K+-ATPase | Inhibitor | Omeprazole |
| Na+/K+ ATPase | Inhibitor | Cardiac glycosides |
| Eukaryotic (putative) sterol transporter (EST) family | Niemann-Pick C1 like 1 (NPC1L1) protein inhibitor | Ezetimibe |
| Neurotransmitter/Na+ symporter (NSS) family | Serotonin/Na+ symporter inhibitor | Cocaine, bicyclic antidepressants, paroxetine |
| | Noradrenaline/Na+ symporter inhibitor | Bupropion, venlafaxine |
| | Dopamine/Na+ symporter inhibitor | Tricyclic antidepressants, cocaine, amphetamines |
| | Vesicular monoamine transporter inhibitor | Reserpine |
| Nucleic acids | | |
| DNA and RNA | Alkylation | Chlorambucil, cyclophosphamide, dacarbazine |
| | Complexation | Cisplatin |
| | Intercalation | Doxorubicin |
| | Oxidative degradation | Bleomycin |
| | Strand breaks | Nitroimidazoles |
| RNA | Interaction with 16S-rRNA | Aminoglycoside antiinfectives |
| | Interaction with 23S-rRNA | Macrolide antiinfectives |
| | 23S-rRNA/tRNA/2-polypeptide complex | Oxazolidinone antiinfectives |
| Spindle | Inhibition of development | Vinca alkaloids |
| | Inhibition of desaggregation | Taxanes |
| Inhibition of mitosis | — | Colchicine |
| Ribosome | | |
| 30S subunit (bacterial) | Inhibitors | Tetracyclines |
| 50S subunit (bacterial) | Inhibitors | Lincosamides, quinupristin-dalfopristin |

TABLE 22

Exemplary sequences of a degradation domain

| SEQ ID NO | Description | Sequence |
|---|---|---|
| SEQ ID NO: 44 | ER1 WT (305aa-549aa) amino acid sequence | SLALSLTADQMVSALLDAEPPILYSEYDPTRPFS EASMMGLLTNLADRELVHMINWAKRVPGFVDLTL HDQVHLLECAWLEILMIGLVWRSMEHPGKLLFAP NLLLDRNQGKCVEGMVEIFDMLLATSSRFRMMNL QGEEFVCLKSIILLNSGVYTFLSSTLKSLEEKDH IHRVLDKITDTLIHLMAKAGLTLQQQHQRLAQLL LILSHIRHMSNKGMEHLYSMKCKNVVPLYDLLLE MLDAHRL |
| SEQ ID NO: 45 | ER1 WT (305aa-549aa) nucleotide sequence | tcgttggcactttccctgactgccgaccagatgg tgtccgcccttctggacgccgagcctccaattct gtactcggagtacgatccgactcgcccgttctcc gaagccagcatgatgggcctgttgactaacctgg cggaccgcgagttggtgcacatgattaactgggc taagcgggtgccgggcttcgtggacctgactctg cacgaccaagtgcacctcctggaatgcgcctggc tggaaatcctcatgatcggcctcgtgtggagatc catggagcatcccggaaagctcctgtttgcaccc aacctcctgcttgatcgcaaccagggaaaatgcg tggaagggatggtcgagattttcgacatgctgct cgccacctcttcccggttccggatgatgaatctg cagggagaagagttcgtgtgtctgaagtcaatca tcctgctgaactccggggtctataccttcctgag ctcgaccctcaagtcactggaggaaaaagaccac atccatcgcgtgctcgataagatcaccgacaccc ttatccatctcatggcgaaggctggactgaccct gcaacagcagcaccagaggctgcccagagctgc tgattctgagccacatccggcacatgtcgaacaa ggggatggaacacctgtacagcatgaagtgcaag aacgtcgtgcctctgtacgatctgctcctggaaa tgctggacgcgcacagactc |
| SEQ ID NO: 46 | ERmut1 (6 mutations) amino acid sequence | SLALSLTADQMVSALLDAEPPILYSEYDPTRPFS EASMMGLLTNLADRELVHMINWAKRVPGFVDLAL HDQVHLLECAWMEILMIGLVWRSMEHPGKLLFAP NLLLDRNQGKCVEGGVEIFDMLLATSSRFRMMNL QGEEFVCLKSIILLNSGVYTFLSSTLKSLEEKDH IHRVLDKITDTLIHLMAKAGLTLQQQHQRLAQLL LILSHIRHMSSKRMEHLYSMKCKNVVPLSDLLLE MLDAHRL |
| SEQ ID NO: 47 | ERmut1 (6 mutations) nucleotide sequence | tcgttggcactttccctgactgccgaccagatgg tgtccgcccttctggacgccgagcctccaattct gtactcggagtacgatccgactcgcccgttctcc gaagccagcatgatgggcctgttgactaacctgg cggaccgcgagttggtgcacatgattaactgggc taagcgggtgccgggcttcgtggacctggccctg cacgaccaagtgcacctcctggaatgcgcctgga tggaaatcctcatgatcggcctcgtgtggagatc catggagcatcccggaaagctcctgtttgcaccc aacctcctgcttgatcgcaaccagggaaaatgcg tggaaggggtgtcgagattttcgacatgctgct cgccacctcttcccggttccggatgatgaatctg cagggagaagagttcgtgtgtctgaagtcaatca tcctgctgaactccggggtctataccttcctgag ctcgaccctcaagtcactggaggaaaaagaccac atccatcgcgtgctcgataagatcaccgacaccc ttatccatctcatggcgaaggctggactgaccct gcaacagcagcaccagaggctggcccagagctgc tgattctgagccacatccggcacatgtcgtccaa |

TABLE 22-continued

Exemplary sequences of a degradation domain

| SEQ ID NO | Description | Sequence |
|---|---|---|
| | | gaggatggaacacctgtacagcatgaagtgcaag aacgtcgtgcctctgtccgatctgctcctggaaa tgctggacgcgcacagactc |
| SEQ ID NO: 48 | ERmut2 (4 mutations) amino acid sequence | SLALSLTADQMVSALLDAEPPILYSEYDPTRPFS EASMMGLLTNLADRELVHMINWAKRVPGFVDLTL HDQVHLLECAWMEILMIGLVWRSMEHPGKLLFAP NLLLDRNQGKCVEGGVEIFDMLLATSSRFRMMNL QGEEFVCLKSIILLNSGVYTFLSSTLKSLEEKDH IHRVLDKITDTLIHLMAKAGLTLQQQHQRLAQLL LILSHIRHMSNKRMEHLYSMKCKNVVPLSDLLLE MLDAHRL |
| SEQ ID NO: 49 | ERmut2 (4 mutations) nucleo- tide sequence | tcgttggcactttccctgactgccgaccagatgg tgtccgcccttctggacgccgagcctccaattct gtactcggagtacgatccgactcgcccgttctcc gaagccagcatgatgggcctgttgactaacctgg cggaccgcgagttggtgcacatgattaactgggc taagcgggtgccgggcttcgtggacctgaccctg cacgaccaagtgcacctcctggaatgcgcctgga tggaaatcctcatgatcggcctcgtgtggagatc catggagcatcccggaaagctcctgtttgcaccc aacctcctgcttgatcgcaaccagggaaaatgcg tggaagggggtgtcgagattttcgacatgctgct cgccacctcttcccggttccggatgatgaatctg cagggagaagagttcgtgtgtctgaagtcaatca tcctgctgaactccggggtctataccttcctgag ctcgaccctcaagtcactggaggaaaaagaccac atccatcgcgtgctcgataagataccgacaccc ttatccatctcatggcgaaggctggactgaccct gcaacagcagcaccagaggctggcccagagctgc tgattctgagccacatccggcacatgtcgaacaa gaggatggaacacctgtacagcatgaagtgcaag aacgtcgtgcctctgtccgatctgctcctggaaa tgctggacgcgcacagactc |
| SEQ ID NO: 50 | FKBP L106P amino acid sequence | GVQVETISPGDGRTFPKRGQTCVVHYTGMLEDGK KVDSSRDRNKPFKFMLGKQEVIRGWEEGVAQMSV GQRAKLTISPDYAYGATGHPGIIPPHATLVFDVE LLKPE |
| SEQ ID NO: 51 | DHFR R12Y/G27S/ Y100I amino acid sequence | ISLIAALAVDYVIGMENAMPWNLPADLAWFKRNT LNKPVIMGRHTWESIGRPLPGRKNIILSSQPSTD DRVTWVKSVDEAIAACGDVPEIMVIGGGRVIEQF LPKAQKLYLTHIDAEVEGDTHFPDYEPDDWESVF SEFHDADAQNSHSYCFEILERR |

Degradation domains can be engineered from known proteins (e.g., those proteins set forth in Table 21) through any of a variety of routine methods known in the art. Generally, such methods employ first creating a library of interest including proteins derived from the, e.g., naturally occurring protein. Second, cells or cell populations expressing proteins from individual library constructs will be selected on the basis of whether the expression of the derived protein is dependent on the presence of the desired stabilization compound. The process of derivation and selection can be repeated in as many cycles as necessary to identify a suitable candidate.

For example, a library can be created through rational protein design based on sampling different structures and putative affinities of the protein domain to the selected compound. Alternatively, a library can be generated by random mutagenesis of the target protein. In either case, e.g., Jurkat cells can be transduced with a lentiviral library generated from the constructs. Jurkat cells can then undergo a round of FACS sorting, to eliminate cells that constitutively express the protein of interest. In the next stage, the sorted cells are incubated with the compound of choice for 24 hrs and positive cells are FACS sorted. These are expanded through single cell cloning. From there, individual transduced clones will be assessed for the ability to induce expression of the protein of interest in a compound-dependent manner.

In some embodiments, the fusion polypeptide of the invention comprises a degradation domain, a COF1/CRBN-, COF2/CRBN-, or COF3/CRBN-binding polypeptide, and a heterologous polypeptide. In some embodiments, the expression level of the fusion polypeptide in the presence of the stabilization compound is increased by at least, e.g., 1.5-, 2-, 3-, 4-, 5-, 10-, 20-, 30-, 40-, or 50-fold, compared to the expression level of the fusion polypeptide in the absence of the stabilization compound, e.g., as measured by an assay described herein, e.g., a Western blot analysis or a flow cytometry analysis.

Cleavage Site

In some embodiments, the fusion polypeptide of the invention comprises a first domain and a second domain separated by a heterologous cleavage site, wherein the first domain comprises a degradation domain and the second domain comprises a COF1/CRBN-, COF2/CRBN-, or COF3/CRBN-binding polypeptide and a heterologous polypeptide.

The cleavage site can either be a self-cleavage site and/or a protease cleavage site. The cleavage site can be designed to be cleaved by any site-specific protease that is expressed in a cell of interest (either through recombinant expression or endogenous expression) at adequate levels to cleave off the degradation domain. In important aspects of the invention, the protease cleavage site is chosen to correspond to a protease natively (or by virtue of cell engineering) to be present in a cellular compartment relevant to the expression of the protein of interest. The intracellular trafficking of the protease should overlap or partially overlap with the intracellular trafficking of the protein of interest that contains the degradation domain employed. For example, if the protein of interest is located at the cell surface, the enzyme to cleave it can be added exogenously to the cell.

If the protein of interest resides in the endosomal/lysosomal system a protease cleavage site for an enzyme resident in those compartments can be used. Such protease/consensus motifs include, e.g., Furin: RX(K/R)R consensus motif (X can be any amino acid; SEQ ID NO: 52)

PCSK1: RX(K/R)R consensus motif (X can be any amino acid; SEQ ID NO: 52)

PCSK5: RX(K/R)R consensus motif (X can be any amino acid; SEQ ID NO: 52)

PCSK6: RX(K/R)R consensus motif (X can be any amino acid; SEQ ID NO: 52)

PCSK7: RXXX[KR]R consensus motif (X can be any amino acid; SEQ ID NO: 53)

Cathepsin B:
RRX  (SEQ ID NO: 54)

Granzyme B:
I-E-P-D-X  (SEQ ID NO: 55)

-continued

Factor XA:
(SEQ ID NO: 56)
Ile-Glu/Asp-Gly-Arg

Enterokinase:
(SEQ ID NO: 57)
Asp-Asp-Asp-Asp-Lys

Genenase:
(SEQ ID NO: 58)
Pro-Gly-Ala-Ala-His-Tyr

Sortase:
(SEQ ID NO: 59)
LPXTG/A

PreScission protease:
(SEQ ID NO: 60)
Leu-Glu-Val-Phe-Gln-Gly-Pro

Thrombin:
(SEQ ID NO: 61)
Leu-Val-Pro-Arg-Gly-Ser

TEV protease:
(SEQ ID NO: 62)
E-N-L-Y-F-Q-G

Elastase 1:
(SEQ ID NO: 63)
[AGSV]-X;
X can be any amino acid

In some embodiments, the fusion polypeptide described herein includes a furin cleavage site. In some embodiments, the fusion polypeptides described herein include any one of furin cleavage sites listed in Table 23.

In some embodiments, the fusion polypeptides described herein include a furin cleavage site selected from RTKR (SEQ ID NO: 123) or a sequence having at least 90%, 95%, 97%, 98%, or 99% identity thereto; GTGAEDPRPSRKRRSLGDVG (SEQ ID NO: 125) or a sequence having at least 90%, 95%, 97%, 98%, or 99% identity thereto; GTGAEDPRPSRKRR (SEQ ID NO: 127) or a sequence having at least 90%, 95%, 97%, 98%, or 99% identity thereto; LQWLEQQVAKRRTKR (SEQ ID NO: 129) or a sequence having at least 90%, 95%, 97%, 98%, or 99% identity thereto; GTGAEDPRPSRKRRSLGG (SEQ ID NO: 131) or a sequence having at least 90%, 95%, 97%, 98%, or 99% identity thereto; GTGAEDPRPSRKRRSLG (SEQ ID NO: 133) or a sequence having at least 90%, 95%, 97%, 98%, or 99% identity thereto; SLNLTESHNSRKKR (SEQ ID NO: 135) or a sequence having at least 90%, 95%, 97%, 98%, or 99% identity thereto; or CKINGYPKRGRKRR (SEQ ID NO: 137) or a sequence having at least 90%, 95%, 97%, 98%, or 99% identity thereto.

In some embodiments, the fusion polypeptides described herein include a furin cleavage site selected from RTKR (SEQ ID NO: 123); GTGAEDPRPSRKRRSLGDVG (SEQ ID NO: 125); GTGAEDPRPSRKRR (SEQ ID NO: 127); LQWLEQQVAKRRTKR (SEQ ID NO: 129); GTGAEDPRPSRKRRSLGG (SEQ ID NO: 131); GTGAEDPRPSRKRRSLG (SEQ ID NO: 133); SLNLTESHNSRKKR (SEQ ID NO: 135); or CKINGYPKRGRKRR (SEQ ID NO: 137).

In some embodiments, the fusion polypeptides described herein include a furin cleavage site selected from GTGAEDPRPSRKRRSLGDVG (SEQ ID NO: 125) or a sequence having at least 90%, 95%, 97%, 98%, or 99% identity thereto, or GTGAEDPRPSRKRR (SEQ ID NO: 127) or a sequence having at least 90%, 95%, 97%, 98%, or 99% identity thereto.

In some embodiments, the fusion polypeptides described herein include a furin cleavage site selected from GTGAEDPRPSRKRRSLGDVG (SEQ ID NO: 125) or GTGAEDPRPSRKRR (SEQ ID NO: 127).

In some embodiments, the fusion polypeptides described herein include the furin cleavage site of GTGAEDPRPSRKRRSLGDVG (SEQ ID NO: 125).

TABLE 23

Exemplary furin cleavage site

| | Amino acid sequence | Nucleic acid sequence |
|---|---|---|
| Furin cleavage site1 | RTKR (SEQ ID NO: 123) | cgtactaaaaga (SEQ ID NO: 139) |
| Furin cleavage site2 | GTGAEDPRP SRVG (SEQ ID NO: 125) | ggaaccggcgcggaagaccccc ggccctccaggaagcgaaggtc cctcggagacgtgggt (SEQ ID NO: 126) |
| Furin cleavage site3 | GTGAEDPRP SRKRR (SEQ ID NO: 127) | ggaaccggcgcggaagaccccc ggccctccaggaagcgaagg (SEQ ID NO: 128) |
| Furin cleavage site4 | LQWLEQQVA KRRTKR (SEQ ID NO: 129) | ctgcaatggctggagcagcagg tggcgaagcggagaactaag cgg (SEQ ID NO: 130) |
| Furin cleavage site5 | GTGAEDPRP SRKRRSLGG (SEQ ID NO: 131) | ggcacaggtgccgaggaccctc ggccaagccgcaaaaggaggtc acttggcggc (SEQ ID NO: 132) |
| Furin cleavage site6 | GTGAEDPRP SRKRRSLG (SEQ ID NO: 133) | ggaaccggagcagaagatccca gaccaagccggaaaaggcggtc cctgggt (SEQ ID NO: 134) |
| Furin cleavage site7 | SLNLTESHN SRKKR (SEQ ID NO: 135) | agtctcaatttgactgagtcac acaattccaggaagaaaagg (SEQ ID NO: 136) |
| Furin cleavage site8 | CKINGYPKR GRKRR (SEQ ID NO: 137) | tgcaagatcaacggctaccta agaggggcagaaagcgg cgg (SEQ ID NO: 138) |

Signal Peptide

In certain embodiments, the fusion polypeptides of the invention further include a signal peptide. Signal peptides are useful if it is desirable to have the protein follow the secretory pathway. In some embodiments, this signal peptide will be engineered to be present at the very N-terminus of the fusion polypeptide. Exemplary signal peptides are set forth below:

CD8:
(SEQ ID NO: 64)
MALPVTALLLPLALLLHAARP

GMCSFR:
(SEQ ID NO: 65)
MLLLVTSLLLCELPHPAFLLIP

IL2:
(SEQ ID NO: 66)
MYRMQLLSCIALSLALVTNS

-continued

IgK chain:
(SEQ ID NO: 67)
MAQVKLQESGTELAKPGAAVK

NPC2:
(SEQ ID NO: 68)
MRFLAATFLLLALSTAAQA

LAMB1:
(SEQ ID NO: 69)
MGLLQLLAFSFLALCRARVRA

P3IP1:
(SEQ ID NO: 70)
MLLAWVQAFLVSNMLLAEAYG

DMKN:
(SEQ ID NO: 71)
MKFQGPLACLLLALCLGSGEA

TPA:
(SEQ ID NO: 72)
MDAMKRGLCCVLLLCGAVFVSP

PCSK9:
(SEQ ID NO: 73)
MGTVSSRRSWWPLPLLLLLLLLLGPAGARAQEDED

KDEL (SEQ ID NO: 74) or KKXX (X can be any amino acid; SEQ ID NO: 75) and derivatives at the very C-terminus of the protein of interest can be engineered if the protein of interest is an ER-resident protein. These sequences must be inserted together with the signal peptide.

Proteins of interest can be engineered to include glycosylation patterns for internalization via mannose-6-phosphate receptor and targeting to the endosomal/lysosomal system. These should be included in the protein of interest itself, if this is a protein resident in that compartment. Consensus for N-glycosylation is Asn-X-Ser/Thr, where X is any amino acid except proline (Pro), serine (Ser), and threonine (Thr) (SEQ ID NO: 76).

In embodiments where it is desirable to have proteins of interested targeted at the peroxisome, the fusion polypeptide can be engineered to include a C-terminal peroxisomal targeting signal (e.g., PTS1: -SKL).

Nucleic Acid and Vectors Encoding Fusion Polypeptides

In another aspect, the invention pertains to a nucleic acid encoding any of the fusion polypeptides described herein, or a vector comprising such a nucleic acid. In one embodiment, the vector is chosen from a DNA vector, an RNA vector, a plasmid, a lentivirus vector, adenoviral vector, or a retrovirus vector. In one embodiment, the vector is a lentivirus vector.

The present disclosure also provides vectors in which a DNA of the present disclosure is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (w), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713, which is hereby incorporated herein by reference.

In another embodiment, the vector comprising the nucleic acid encoding the desired fusion polypeptide of the invention is an adenoviral vector (A5/35). In another embodiment, the expression of nucleic acids encoding chimeric molecules can be accomplished using transposons such as sleeping beauty, using gene editing tools such as CRISPR (e.g., CAS9), or using zinc finger nucleases. See, e.g., June et al. 2009, Nature Reviews Immunology 9.10: 704-716, which is hereby incorporated herein by reference.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Nucleic Acid Constructs Encoding the Fusion Polypeptides, e.g., a CAR Comprising a COF1/CRBN-, COF2/CRBN-, or COF3/CRBN-Binding Polypeptide The present disclosure also provides nucleic acid molecules encoding one or more of the fusion polypeptide disclosed herein.

In one embodiment, the fusion polypeptide comprises a CAR constructs that targets a tumor antigen and/or a B cell antigen described herein. In one aspect, the nucleic acid molecule is provided as a messenger RNA transcript. In one aspect, the nucleic acid molecule is provided as a DNA construct.

Accordingly, in one aspect, the invention pertains to a nucleic acid molecule encoding a fusion polypeptide that comprises a COF1/CRBN-, COF2/CRBN-, or COF3/CRBN-binding polypeptide and a heterologous polypeptide. In some embodiments, the heterologous polypeptide is a chimeric antigen receptor (CAR), wherein the CAR comprises an antigen binding domain that binds to a tumor antigen described herein or a B cell antigen described herein, a transmembrane domain (e.g., a transmembrane domain described herein), and an intracellular signaling domain (e.g., an intracellular signaling domain described herein) comprising a stimulatory domain, e.g., a costimulatory signaling domain (e.g., a costimulatory signaling domain described herein) and/or a primary signaling domain (e.g., a primary signaling domain described herein, e.g., a zeta chain described herein). In one embodiment, the transmembrane domain is transmembrane domain of a protein selected from the group consisting of the alpha, beta or zeta chain of the T-cell receptor, CD28, CD3 epsilon, CD45, CD4, CD5, CD8, CD9, CD16, CD22, CD33, CD37, CD64, CD80, CD86, CD134, CD137 and CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7Rα, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, and NKG2C.

In one embodiment, the transmembrane domain comprises the sequence of SEQ ID NO: 155, or a sequence with 95-99% identity thereof. In one embodiment, the antigen binding domain is connected to the transmembrane domain by a hinge region, e.g., a hinge described herein. In one embodiment, the hinge region comprises SEQ ID NO: 147 or SEQ ID NO: 149 or SEQ ID NO: 151 or SEQ ID NO: 153, or a sequence with 95-99% identity thereof. In one embodiment, the isolated nucleic acid molecule further comprises a sequence encoding a costimulatory domain. In one embodiment, the costimulatory domain is a functional signaling domain of a protein selected from the group consisting of OX40, CD27, CD28, CDS, ICAM-1, LFA-1 (CD11a/CD18), ICOS (CD278), and 4-1BB (CD137). Further examples of such costimulatory molecules include CDS, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, NKG2D, and NKG2C. In one embodiment, the intracellular signaling domain comprises a functional signaling domain of 4-1BB and a functional signaling domain of CD3 zeta. In one embodiment, the intracellular signaling domain comprises the sequence of SEQ ID NO: 158, 161, 176, or 180, or a sequence with 95-99% identity thereof, and the sequence of SEQ ID NO: 163 or SEQ ID NO: 166, or a sequence with 95-99% identity thereof, wherein the sequences comprising the intracellular signaling domain are expressed in the same frame and as a single polypeptide chain.

In another aspect, the invention pertains to an isolated nucleic acid molecule encoding a fusion polypeptide, e.g., as described herein, comprising a domain that includes a CAR construct comprising a leader sequence of SEQ ID NO: 64, a scFv domain as described herein, a hinge region of SEQ ID NO: 147 or SEQ ID NO: 149 or SEQ ID NO: 151 or SEQ ID NO: 153 (or a sequence with 95-99% identity thereof), a transmembrane domain having a sequence of SEQ ID NO: 155 (or a sequence with 95-99% identity thereof), a 4-1BB costimulatory domain having a sequence of SEQ ID NO:158, a CD27 costimulatory domain having a sequence of SEQ ID NO: 161 (or a sequence with 95-99% identity thereof), a ICOS costimulatory domain having a sequence of SEQ ID NO: 176 (or a sequence with 95-99% identity thereof) or a CD28 costimulatory domain having a sequence of SEQ ID NO: 180, and a CD3 zeta stimulatory domain having a sequence of SEQ ID NO: 163 or SEQ ID NO: 166 (or a sequence with 95-99% identity thereof).

The nucleic acid sequences coding for the desired molecules can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The present disclosure also provides vectors in which a nucleic acid of the present disclosure is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

In brief summary, the expression of recombinant nucleic acids encoding a fusion polypeptide of this invention is typically achieved by operably linking a nucleic acid encoding the fusion polypeptide to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs of the present disclosure may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al., 2012, MOLECULAR CLONING: A LABORATORY MANUAL, volumes 1-4, Cold Spring Harbor Press, NY), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription. Exemplary promoters include the CMV IE gene, EF-1α, ubiquitin C, or phosphoglycerokinase (PGK) promoters.

In some embodiments, the promoter is a tissue specific promoter. In some embodiments, the promoter is activated at a specific developmental stage. In some embodiments, the promoter is an inducible promoter. In some embodiments, the promoter is a tetracycline inducible promoter. In some embodiments, the promoter is a metallothionein promoter. In some embodiments, the promoter is an HSV TK promoter.

An example of a promoter that is capable of expressing a fusion polypeptide, e.g., as described herein, comprising a domain that includes aCAR encoding nucleic acid molecule in a mammalian T cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving expression of a fusion polypeptide, e.g., as described herein, a fusion polypeptide comprising a domain that includes a CAR, from nucleic acid molecules cloned into a lentiviral vector. See, e.g., Milone et al., Mol. Ther. 17(8): 1453-1464 (2009). In one aspect, the EF1a promoter comprises the sequence provided as SEQ ID NO:1.

Another example of a promoter is the immediate early cytomegalovirus (CMV) promoter sequence. This promoter sequence is a strong constitutive promoter sequence capable of driving high levels of expression of any polynucleotide sequence operatively linked thereto. However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1 promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

Another example of a promoter is the phosphoglycerate kinase (PGK) promoter. In embodiments, a truncated PGK promoter (e.g., a PGK promoter with one or more, e.g., 1, 2, 5, 10, 100, 200, 300, or 400, nucleotide deletions when compared to the wild-type PGK promoter sequence) may be desired. The nucleotide sequences of exemplary PGK promoters are provided below.

WT PGK Promoter
(SEQ ID NO: 823)
ACCCCTCTCTCCAGCCACTAAGCCAGTTGCTCCCTCGGCTGACGGCTG

CACGCGAGGCCTCCGAACGTCTTACGCCTTGTGGCGCGCCCGTCCTTG

TCCCGGGTGTGATGGCGGGGTGTGGGGCGGAGGGCGTGGCGGGGAAGG

GCCGGCGACGAGAGCCGCGCGGGACGACTCGTCGGCGATAACCGGTGT

CGGGTAGCGCCAGCCGCGCGACGGTAACGAGGGACCGCGACAGGCAGA

CGCTCCCATGATCACTCTGCACGCCGAAGGCAAATAGTGCAGGCCGTG

CGGCGCTTGGCGTTCCTTGGAAGGGCTGAATCCCCGCCTCGTCCTTCG

CAGCGGCCCCCGGGTGTTCCCATCGCCGCTTCTAGGCCCACTGCGAC

GCTTGCCTGCACTTCTTACACGCTCTGGGTCCCAGCCGCGGCGACGCA

AAGGGCCTTGGTGCGGGTCTCGTCGGCGCAGGGACGCGTTTGGGTCCC

GACGGAACCTTTTCCGCGTTGGGGTTGGGGCACCATAAGCT

Exemplary truncated PGK Promoters:
PGK100:
(SEQ ID NO: 824)
ACCCCTCTCTCCAGCCACTAAGCCAGTTGCTCCCTCGGCTGACGGCTG

CACGCGAGGCCTCCGAACGTCTTACGCCTTGTGGCGCGCCCGTCCTTG

TCCCGGGTGTGATGGCGGGGTG

PGK200:
(SEQ ID NO: 825)
ACCCCTCTCTCCAGCCACTAAGCCAGTTGCTCCCTCGGCTGACGGCTG

CACGCGAGGCCTCCGAACGTCTTACGCCTTGTGGCGCGCCCGTCCTTG

TCCCGGGTGTGATGGCGGGGTGTGGGGCGGAGGGCGTGGCGGGGAAGG

GCCGGCGACGAGAGCCGCGCGGGACGACTCGTCGGCGATAACCGGTGT

CGGGTAGCGCCAGCCGCGCGACGGTAACG

PGK300:
(SEQ ID NO: 826)
ACCCCTCTCTCCAGCCACTAAGCCAGTTGCTCCCTCGGCTGACGGCTG

CACGCGAGGCCTCCGAACGTCTTACGCCTTGTGGCGCGCCCGTCCTTG

TCCCGGGTGTGATGGCGGGGTGTGGGGCGGAGGGCGTGGCGGGGAAGG

GCCGGCGACGAGAGCCGCGCGGGACGACTCGTCGGCGATAACCGGTGT

CGGGTAGCGCCAGCCGCGCGACGGTAACGAGGGACCGCGACAGGCAGA

CGCTCCCATGATCACTCTGCACGCCGAAGGCAAATAGTGCAGGCCGTG

CGGCGCTTGGCGTTCCTTGGAAGGGCTGAATCCCCG

PGK400:
(SEQ ID NO: 827)
ACCCCTCTCTCCAGCCACTAAGCCAGTTGCTCCCTCGGCTGACGGCTG

CACGCGAGGCCTCCGAACGTCTTACGCCTTGTGGCGCGCCCGTCCTTG

TCCCGGGTGTGATGGCGGGGTGTGGGGCGGAGGGCGTGGCGGGGAAGG

GCCGGCGACGAGAGCCGCGCGGGACGACTCGTCGGCGATAACCGGTGT

CGGGTAGCGCCAGCCGCGCGACGGTAACGAGGGACCGCGACAGGCAGA

CGCTCCCATGATCACTCTGCACGCCGAAGGCAAATAGTGCAGGCCGTG

CGGCGCTTGGCGTTCCTTGGAAGGGCTGAATCCCCGCCTCGTCCTTCG

CAGCGGCCCCCGGGTGTTCCCATCGCCGCTTCTAGGCCCACTGCGAC

GCTTGCCTGCACTTCTTACACGCTCTGGGTCCCAGCCG

A vector may also include, e.g., a signal sequence to facilitate secretion, a polyadenylation signal and transcription terminator (e.g., from Bovine Growth Hormone (BGH) gene), an element allowing episomal replication and replication in prokaryotes (e.g. SV40 origin and ColE1 or others known in the art) and/or elements to allow selection (e.g., ampicillin resistance gene and/or zeocin marker).

In order to assess the expression of a fusion polypeptide, e.g., as described herein, comprising a domain that includes a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

In some embodiments, the vector comprising a nucleic acid sequence encoding a fusion polypeptide described herein, e.g., a fusion polypeptide comprising a CAR molecule described herein, can further comprise a second nucleic acid sequence encoding a polypeptide, e.g., an agent that increases the activity of the fusion polypeptide, e.g., as described herein, comprising a domain that includes CAR molecule. In some embodiments a single nucleic acid molecule, or vector comprising said nucleic acid molecule, encodes multiple fusion polypeptides, e.g., as described herein, each comprising domains that include a CAR, described herein. In some embodiments, the nucleic acid encoding a first fusion polypeptide is under separate regulatory control (e.g., by a promoter described herein) from the nucleic acid encoding a second fusion polypeptide (e.g., by a promoter described herein). In other embodiments, the two or more nucleic acid sequences are encoded by a single nucleic molecule in the same frame and as a single polypeptide chain. In this aspect, the two or more fusion polypeptides, e.g., as described herein, each comprising a domain that includes a CAR, can, e.g., be separated by one or more peptide cleavage sites (e.g., an auto-cleavage site or a substrate for an intracellular protease). Examples of peptide cleavage sites include the following, wherein the GSG residues are optional:

T2A:
(SEQ ID NO: 828)
(GSG) EGRGSLLTCGDVEENPGP

P2A:
(SEQ ID NO: 829)
(GSG) ATNFSLLKQAGDVEENPGP

E2A:
(SEQ ID NO: 830)
(GSG) QCTNYALLKLAGDVESNPGP

F2A:
(SEQ ID NO: 831)
(GSG) VKQTLNFDLLKLAGDVESNPGP

In some embodiments, the present disclosure provides, e.g., a nucleic acid molecule comprising a first nucleic acid sequence encoding a first molecule and a second nucleic acid sequence encoding a second molecule. In some embodiments, the first molecule is a first fusion polypeptide comprising a first COF1/CRBN-, COF2/CRBN-, or COF3/CRBN-binding polypeptide and a first heterologous polypeptide (e.g., a first CAR molecule) and/or the second molecule is a second fusion polypeptide comprising a second COF1/CRBN-, COF2/CRBN-, or COF3/CRBN-binding polypeptide and a second heterologous polypeptide (e.g., a second CAR molecule). In some embodiments, the first and second nucleic acid sequences are disposed on a single nucleic acid molecule. In some embodiments, the first and second nucleic acid sequences are disposed on separate nucleic acid molecules. In some embodiments, the first CAR molecule binds to CD19 (e.g., the first CAR molecule is an anti-CD19 CAR disclosed in Tables 5, 6, 7 and 30) and the second CAR molecule binds to CD22 (e.g., the second CAR molecule is an anti-CD22 CAR disclosed in Tables 19 and 20). In some embodiments, the first CAR molecule binds to CD19 (e.g., the first CAR molecule is an anti-CD19 CAR disclosed in Tables 5, 6, 7 and 30) and the second CAR molecule binds to CD20 (e.g., the second CAR molecule is an anti-CD20 CAR disclosed in Table 32). In embodiments, the nucleic acid molecule comprises RNA or DNA. In embodiments, the first and second nucleic acid sequences are situated in the same orientation, e.g., transcription of the first and second nucleic acid sequences proceeds in the same direction. In embodiments, the first and second nucleic acid sequences are situated in different orientations. In embodiments, a single promoter controls expression of the first and second nucleic acid sequences. In embodiments, a nucleic acid encoding a protease cleavage site (such as a T2A, P2A, E2A, or F2A cleavage site) is situated between the first and second nucleic acid sequences. In embodiments, the protease cleavage site is placed such that a cell can express a fusion protein comprising the first molecule and the second molecule, which protein is subsequently processed into two peptides by proteolytic cleavage. In some embodiments, the first nucleic acid sequence is upstream of the second nucleic acid sequence, or the second nucleic acid sequence is upstream of the first nucleic acid sequence. In embodiments, a first promoter controls expression of the first nucleic acid sequence and a second promoter controls expression of the second nucleic acid sequence. In embodiments, the nucleic acid molecule is a plasmid. In embodiments, the nucleic acid molecule comprises a viral packaging element. In some aspects, the present disclosure provides a cell, e.g., an immune effector cell, comprising the nucleic acid molecule described herein, e.g., a nucleic acid molecule comprising the first and second nucleic acid sequences described above.

The cell may comprise a protease (e.g., endogenous or exogenous) that cleaves a T2A, P2A, E2A, or F2A cleavage site.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al., 2012, MOLECULAR CLONING: A LABORATORY MANUAL, volumes 1-4, Cold Spring Harbor Press, NY). A preferred method for the introduction of a polynucleotide into a host cell is calcium phosphate transfection or electroporation.

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle). Other methods of state-of-the-art targeted delivery of nucleic acids are available, such as delivery of polynucleotides with targeted nanoparticles or other suitable submicron sized delivery system.

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, MO; dicetyl phosphate ("DCP") can be obtained from K & K Laboratories (Plainview, NY); cholesterol ("Choi") can be obtained from Calbiochem-Behring; dimyristyl phosphatidylglycerol ("DMPG") and other lipids may be obtained from Avanti Polar Lipids, Inc. (Birmingham, AL). Stock solutions of lipids in chloroform or chloroform/methanol can be stored at about −20° C. Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., 1991 Glycobiology 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present disclosure, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

The present disclosure further provides a vector comprising a fusion polypeptide, e.g., as described herein, comprising a domain that includes a CAR, -encoding nucleic acid molecule. In one embodiment, the vector comprises a CAR encoding nucleic acid molecule, e.g., as described herein. In one embodiment, the vector comprises two CAR encoding nucleic acid molecules. In one aspect, the one or more CAR vectors (e.g., the vector comprising a first CAR encoding nucleic acid molecule and the vector comprising a second CAR encoding nucleic acid molecule, or the vector comprising both a first and second CAR encoding nucleic acids) can be directly transduced into a cell, e.g., a T cell or a NK cell. In one aspect, the vector is a cloning or expression vector, e.g., a vector including, but not limited to, one or more plasmids (e.g., expression plasmids, cloning vectors, minicircles, minivectors, double minute chromosomes), retroviral and lentiviral vector constructs. In one aspect, the vector is capable of expressing the CAR construct in mammalian immune effector cells (e.g., T cells, NK cells).

In one embodiment, where stable expression of one or more (e.g., one or two) fusion polypeptides, e.g., as described herein, each comprising a domain that includes a CAR, is desired, a vector comprising one or more (e.g., one or two) CAR-encoding nucleic acid molecules is transduced into an immune effector cell. For example, immune effector cells with stable expression of two fusion polypeptides, e.g., as described herein, each comprising a domain that include a CAR, can be generated using lentiviral vectors. Cells that exhibit stable expression of two fusion polypeptides, e.g., as described herein, each comprising a domain that includes a CAR, express the CARs for at least 1 week, 2 weeks, 3 weeks, 4 weeks, 5 weeks, 6 weeks, 7 weeks, 8 weeks, 3 months, 6 months, 9 months, or 12 months after transduction.

In one embodiment, where transient expression of one or more (e.g., one or two) fusion polypeptides, e.g., as described herein, comprising a domain that includes a CAR is desired, one or more (e.g., one or two) fusion polypeptide-encoding nucleic acid molecules are transfected into an immune effector cell. The one or more (e.g., one or two) fusion polypeptides, e.g., as described herein, comprising a domain that includes a CAR, -encoding nucleic acid molecules may be a vector comprising a one or more (e.g., one or two) CAR encoding nucleic acid molecules, or an in vitro transcribed RNA one or more (e.g., one or two) CARs. In vitro transcribed RNA CARs and methods for transfection into immune effector cells are further described below. Cells that exhibit transient expression of a one or more (e.g., one or two) CAR express the one or more (e.g., one or two) CAR for 4, 5, 6, 7, 8, 9, 10, 11, 12, 13, 14, 15 days after transfection.

RNA Transfection

Disclosed herein are methods for producing an in vitro transcribed RNA encoding a fusion polypeptide, e.g., as described herein, comprising a domain that includes a CAR. The present disclosure also includes a fusion polypeptide, e.g., as described herein, comprising a domain that includes CAR, -encoding RNA construct that can be directly transfected into a cell. A method for generating mRNA for use in transfection can involve in vitro transcription (IVT) of a template with specially designed primers, followed by polyA addition, to produce a construct containing 3' and 5' untranslated sequence ("UTR"), a 5' cap and/or Internal Ribosome Entry Site (IRES), the nucleic acid to be expressed, and a polyA tail, typically 50-5000 bases in length (SEQ ID NO: 174). RNA so produced can efficiently transfect different kinds of cells. In one aspect, the template includes sequences for the CAR.

In one aspect, a fusion polypeptide, e.g., as described herein, comprising a domain that includes a CAR, of the present disclosure is encoded by a messenger RNA (mRNA). In one aspect, the mRNA encoding a CAR described herein is introduced into a T cell or a NK cell.

In one embodiment, the in vitro transcribed RNA encoding a fusion polypeptide, e.g., as described herein, comprising a domain that includes a CAR can be introduced to a cell as a form of transient transfection. The RNA is produced by in vitro transcription using a polymerase chain reaction (PCR)-generated template. DNA of interest from any source can be directly converted by PCR into a template for in vitro mRNA synthesis using appropriate primers and RNA polymerase. The source of the DNA can be, for example, genomic DNA, plasmid DNA, phage DNA, cDNA, synthetic DNA sequence or any other appropriate source of DNA. The desired template for in vitro transcription is a fusion polypeptide, e.g., as described herein, comprising a domain that includes a CAR, described herein. For example, the template for the RNA CAR comprises an extracellular region comprising a single chain variable domain of an antibody to an antigen described herein; a hinge region (e.g., a hinge region described herein), a transmembrane domain (e.g., a transmembrane domain described herein such as a transmembrane domain of CD8a); and a cytoplasmic region that includes an intracellular signaling domain, e.g., an intracellular signaling domain described herein, e.g., comprising the signaling domain of CD3-zeta and the signaling domain of 4-1BB.

In one embodiment, the DNA to be used for PCR contains an open reading frame. The DNA can be from a naturally occurring DNA sequence from the genome of an organism. In one embodiment, the nucleic acid can include some or all of the 5' and/or 3' untranslated regions (UTRs). The nucleic acid can include exons and introns. In one embodiment, the DNA to be used for PCR is a human nucleic acid sequence. In another embodiment, the DNA to be used for PCR is a human nucleic acid sequence including the 5' and 3' UTRs. The DNA can alternatively be an artificial DNA sequence that is not normally expressed in a naturally occurring organism. An exemplary artificial DNA sequence is one that contains portions of genes that are ligated together to form an open reading frame that encodes a fusion polypeptide. The portions of DNA that are ligated together can be from a single organism or from more than one organism.

PCR is used to generate a template for in vitro transcription of mRNA which is used for transfection. Methods for performing PCR are well known in the art. Primers for use in PCR are designed to have regions that are substantially complementary to regions of the DNA to be used as a template for the PCR. "Substantially complementary," as used herein, refers to sequences of nucleotides where a majority or all of the bases in the primer sequence are complementary, or one or more bases are non-complementary, or mismatched. Substantially complementary sequences are able to anneal or hybridize with the intended DNA target under annealing conditions used for PCR. The primers can be designed to be substantially complementary to any portion of the DNA template. For example, the primers can be designed to amplify the portion of a nucleic acid that is normally transcribed in cells (the open reading frame), including 5' and 3' UTRs. The primers can also be designed to amplify a portion of a nucleic acid that encodes a particular domain of interest. In one embodiment, the primers are designed to amplify the coding region of a human cDNA, including all or portions of the 5' and 3' UTRs. Primers useful for PCR can be generated by synthetic methods that are well known in the art. "Forward primers" are primers that contain a region of nucleotides that are substantially complementary to nucleotides on the DNA template that are upstream of the DNA sequence that is to be amplified. "Upstream" is used herein to refer to a location 5, to the DNA sequence to be amplified relative to the coding strand. "Reverse primers" are primers that contain a region of nucleotides that are substantially complementary to a double-stranded DNA template that are downstream of the DNA sequence that is to be amplified. "Downstream" is used herein to refer to a location 3' to the DNA sequence to be amplified relative to the coding strand.

Any DNA polymerase useful for PCR can be used in the methods disclosed herein. The reagents and polymerase are commercially available from a number of sources.

Chemical structures with the ability to promote stability and/or translation efficiency may also be used. The RNA preferably has 5' and 3' UTRs. In one embodiment, the 5' UTR is between one and 3000 nucleotides in length. The length of 5' and 3' UTR sequences to be added to the coding region can be altered by different methods, including, but not limited to, designing primers for PCR that anneal to different regions of the UTRs. Using this approach, one of ordinary skill in the art can modify the 5' and 3' UTR lengths required to achieve optimal translation efficiency following transfection of the transcribed RNA.

The 5' and 3' UTRs can be the naturally occurring, endogenous 5' and 3' UTRs for the nucleic acid of interest. Alternatively, UTR sequences that are not endogenous to the nucleic acid of interest can be added by incorporating the UTR sequences into the forward and reverse primers or by any other modifications of the template. The use of UTR sequences that are not endogenous to the nucleic acid of interest can be useful for modifying the stability and/or translation efficiency of the RNA. For example, it is known that AU-rich elements in 3' UTR sequences can decrease the stability of mRNA. Therefore, 3' UTRs can be selected or designed to increase the stability of the transcribed RNA based on properties of UTRs that are well known in the art.

In one embodiment, the 5' UTR can contain the Kozak sequence of the endogenous nucleic acid. Alternatively, when a 5' UTR that is not endogenous to the nucleic acid of interest is being added by PCR as described above, a consensus Kozak sequence can be redesigned by adding the 5' UTR sequence. Kozak sequences can increase the efficiency of translation of some RNA transcripts, but does not appear to be required for all RNAs to enable efficient translation. The requirement for Kozak sequences for many mRNAs is known in the art. In other embodiments the 5' UTR can be 5'UTR of an RNA virus whose RNA genome is stable in cells. In other embodiments various nucleotide analogues can be used in the 3' or 5' UTR to impede exonuclease degradation of the mRNA.

To enable synthesis of RNA from a DNA template without the need for gene cloning, a promoter of transcription should be attached to the DNA template upstream of the sequence to be transcribed. When a sequence that functions as a promoter for an RNA polymerase is added to the 5' end of the forward primer, the RNA polymerase promoter becomes incorporated into the PCR product upstream of the open reading frame that is to be transcribed. In one preferred embodiment, the promoter is a T7 polymerase promoter, as described elsewhere herein. Other useful promoters include, but are not limited to, T3 and SP6 RNA polymerase promoters. Consensus nucleotide sequences for T7, T3 and SP6 promoters are known in the art.

In a preferred embodiment, the mRNA has both a cap on the 5' end and a 3' poly(A) tail which determine ribosome binding, initiation of translation and stability mRNA in the cell. On a circular DNA template, for instance, plasmid DNA, RNA polymerase produces a long concatameric product which is not suitable for expression in eukaryotic cells. The transcription of plasmid DNA linearized at the end of the 3' UTR results in normal sized mRNA which is not effective in eukaryotic transfection even if it is polyadenylated after transcription.

On a linear DNA template, phage T7 RNA polymerase can extend the 3' end of the transcript beyond the last base of the template (Schenborn and Mierendorf, Nuc Acids Res., 13:6223-36 (1985); Nacheva and Berzal-Herranz, Eur. J. Biochem., 270:1485-65 (2003).

The conventional method of integration of polyA/T stretches into a DNA template is molecular cloning. However polyA/T sequence integrated into plasmid DNA can cause plasmid instability, which is why plasmid DNA templates obtained from bacterial cells are often highly contaminated with deletions and other aberrations. This makes cloning procedures not only laborious and time consuming but often not reliable. That is why a method which allows construction of DNA templates with polyA/T 3' stretch without cloning highly desirable.

The polyA/T segment of the transcriptional DNA template can be produced during PCR by using a reverse primer containing a polyT tail, such as 100T tail (SEQ ID NO: 832) (size can be 50-5000 T (SEQ ID NO: 833)), or after PCR by any other method, including, but not limited to, DNA ligation or in vitro recombination. Poly(A) tails also provide stability to RNAs and reduce their degradation. Generally, the length of a poly(A) tail positively correlates with the stability of the transcribed RNA. In one embodiment, the poly(A) tail is between 100 and 5000 adenosines (SEQ ID NO: 834).

Poly(A) tails of RNAs can be further extended following in vitro transcription with the use of a poly(A) polymerase, such as E. coli polyA polymerase (E-PAP). In one embodiment, increasing the length of a poly(A) tail from 100 nucleotides to between 300 and 400 nucleotides (SEQ ID NO: 835) results in about a two-fold increase in the translation efficiency of the RNA. Additionally, the attachment of different chemical groups to the 3' end can increase mRNA stability. Such attachment can contain modified/artificial nucleotides, aptamers and other compounds. For example, ATP analogs can be incorporated into the poly(A) tail using poly(A) polymerase. ATP analogs can further increase the stability of the RNA.

5' caps on also provide stability to RNA molecules. In a preferred embodiment, RNAs produced by the methods disclosed herein include a 5' cap. The 5' cap is provided using techniques known in the art and described herein (Cougot, et al., Trends in Biochem. Sci., 29:436-444 (2001); Stepinski, et al., RNA, 7:1468-95 (2001); Elango, et al., Biochim. Biophys. Res. Commun., 330:958-966 (2005)).

The RNAs produced by the methods disclosed herein can also contain an internal ribosome entry site (IRES) sequence. The IRES sequence may be any viral, chromosomal or artificially designed sequence which initiates cap-independent ribosome binding to mRNA and facilitates the initiation of translation. Any solutes suitable for cell electroporation, which can contain factors facilitating cellular permeability and viability such as sugars, peptides, lipids, proteins, antioxidants, and surfactants can be included.

RNA can be introduced into target cells using any of a number of different methods, for instance, commercially available methods which include, but are not limited to, electroporation (Amaxa Nucleofector-II (Amaxa Biosystems, Cologne, Germany)), (ECM 830 (BTX) (Harvard Instruments, Boston, Mass.) or the Gene Pulser II (BioRad, Denver, Colo.), Multiporator (Eppendort, Hamburg Germany), cationic liposome mediated transfection using lipofection, polymer encapsulation, peptide mediated transfection, or biolistic particle delivery systems such as "gene guns" (see, for example, Nishikawa, et al. Hum Gene Ther., 12(8):861-70 (2001).

Non-Viral Delivery Methods

In some aspects, non-viral methods can be used to deliver a nucleic acid encoding a chimeric molecule or fusion polypeptide described herein into a cell or tissue or a subject.

In some embodiments, the non-viral method includes the use of a transposon (also called a transposable element). In some embodiments, a transposon is a piece of DNA that can insert itself at a location in a genome, for example, a piece of DNA that is capable of self-replicating and inserting its copy into a genome, or a piece of DNA that can be spliced out of a longer nucleic acid and inserted into another place in a genome. For example, a transposon comprises a DNA sequence made up of inverted repeats flanking genes for transposition.

In some embodiments, cells, e.g., T or NK cells, are generated that express a chimeric molecule or fusion polypeptide, e.g., as described herein, by using a combination of gene insertion using the SBTS and genetic editing using a nuclease (e.g., Zinc finger nucleases (ZFNs), Transcription Activator-Like Effector Nucleases (TALENs), the CRISPR/Cas system, or engineered meganuclease re-engineered homing endonucleases).

In some embodiments, use of a non-viral method of delivery permits reprogramming of cells, e.g., T or NK cells, and direct infusion of the cells into a subject. Advantages of non-viral vectors include but are not limited to the ease and relatively low cost of producing sufficient amounts required to meet a patient population, stability during storage, and lack of immunogenicity.

Cells

Also provided herein are cells, e.g., immune effector cells (e.g., a population of cells, e.g., a population of immune effector cells) comprising a nucleic acid molecule, a fusion polypeptide molecule, or a vector, e.g., as described herein. In some embodiments, the provided cells comprise a fusion polypeptide, e.g., as described herein, comprising a domain that includes a CAR, a nucleic acid molecule encoding a fusion polypeptide comprising a domain that includes a CAR, or a vector comprising the same.

In certain aspects, immune effector cells, e.g., T cells or NK cells, can be obtained from a unit of blood collected from a subject using any number of techniques known to the skilled artisan, such as Ficoll™ separation. In one preferred aspect, cells from the circulating blood of an individual are obtained by apheresis. The apheresis product typically contains lymphocytes, including T cells, monocytes, granulocytes, B cells, other nucleated white blood cells, red blood cells, and platelets. In one aspect, the cells collected by apheresis may be washed to remove the plasma fraction and, optionally, to place the cells in an appropriate buffer or media for subsequent processing steps. In one embodiment, the cells are washed with phosphate buffered saline (PBS). In an alternative embodiment, the wash solution lacks calcium and may lack magnesium or may lack many if not all divalent cations.

Initial activation steps in the absence of calcium can lead to magnified activation. As those of ordinary skill in the art would readily appreciate a washing step may be accomplished by methods known to those in the art, such as by using a semi-automated "flow-through" centrifuge (for example, the Cobe 2991 cell processor, the Baxter CytoMate, or the Haemonetics Cell Saver 5) according to the manufacturer's instructions. After washing, the cells may be resuspended in a variety of biocompatible buffers, such as, for example, Ca-free, Mg-free PBS, PlasmaLyte A, or other saline solution with or without buffer. Alternatively, the undesirable components of the apheresis sample may be removed and the cells directly resuspended in culture media.

It is recognized that the methods of the application can utilize culture media conditions comprising 5% or less, for example 2%, human AB serum, and employ known culture media conditions and compositions, for example those described in Smith et al., "Ex vivo expansion of human T cells for adoptive immunotherapy using the novel Xeno-free CTS Immune Cell Serum Replacement" Clinical & Translational Immunology (2015) 4, e31; doi:10.1038/cti.2014.31.

In one aspect, T cells are isolated from peripheral blood lymphocytes by lysing the red blood cells and depleting the monocytes, for example, by centrifugation through a PERCOLL™ gradient or by counterflow centrifugal elutriation.

The methods described herein can include, e.g., selection of a specific subpopulation of immune effector cells, e.g., T cells, that are a T regulatory cell-depleted population, CD25+ depleted cells, using, e.g., a negative selection technique, e.g., described herein. Preferably, the population of T regulatory depleted cells contains less than 30%, 25%, 20%, 15%, 10%, 5%, 4%, 3%, 2%, 1% of CD25+ cells.

In one embodiment, T regulatory cells, e.g., CD25+ T cells, are removed from the population using an anti-CD25 antibody, or fragment thereof, or a CD25-binding ligand, IL-2. In one embodiment, the anti-CD25 antibody, or fragment thereof, or CD25-binding ligand is conjugated to a substrate, e.g., a bead, or is otherwise coated on a substrate, e.g., a bead. In one embodiment, the anti-CD25 antibody, or fragment thereof, is conjugated to a substrate as described herein.

In one embodiment, the T regulatory cells, e.g., CD25+ T cells, are removed from the population using CD25 depletion reagent from Miltenyi™. In one embodiment, the ratio of cells to CD25 depletion reagent is 1e7 cells to 20 uL, or 1e7 cells to 15 uL, or 1e7 cells to 10 uL, or 1e7 cells to 5 uL, or 1e7 cells to 2.5 uL, or 1e7 cells to 1.25 uL. In one embodiment, e.g., for T regulatory cells, e.g., CD25+ depletion, greater than 500 million cells/ml is used. In a further aspect, a concentration of cells of 600, 700, 800, or 900 million cells/ml is used.

In one embodiment, the population of immune effector cells to be depleted includes about $6\times10^9$ CD25+ T cells. In other aspects, the population of immune effector cells to be depleted include about $1\times10^9$ to $1\times1010$ CD25+ T cell, and any integer value in between. In one embodiment, the resulting population T regulatory depleted cells has $2\times10^9$ T regulatory cells, e.g., CD25+ cells, or less (e.g., $1\times10^9$, $5\times10^8$, $1\times10^8$, $5\times10^7$, $1\times10^7$, or less CD25+ cells).

In one embodiment, the T regulatory cells, e.g., CD25+ cells, are removed from the population using the CliniMAC system with a depletion tubing set, such as, e.g., tubing 162-01. In one embodiment, the CliniMAC system is run on a depletion setting such as, e.g., DEPLETION2.1.

Without wishing to be bound by a particular theory, decreasing the level of negative regulators of immune cells (e.g., decreasing the number of unwanted immune cells, e.g., TREG cells), in a subject prior to apheresis or during manufacturing of a fusion polypeptide, e.g., as described herein, comprising a domain that includes a CAR, -expressing cell product can reduce the risk of subject relapse. For example, methods of depleting TREG cells are known in the art. Methods of decreasing TREG cells include, but are not limited to, cyclophosphamide, anti-GITR antibody (an anti-GITR antibody described herein), CD25-depletion, and combinations thereof.

In some embodiments, the manufacturing methods comprise reducing the number of (e.g., depleting) TREG cells prior to manufacturing of the fusion polypeptide, e.g., as described herein, comprising a domain that includes a CAR, -expressing cell. For example, manufacturing methods comprise contacting the sample, e.g., the apheresis sample, with an anti-GITR antibody and/or an anti-CD25 antibody (or fragment thereof, or a CD25-binding ligand), e.g., to deplete TREG cells prior to manufacturing of the CAR-expressing cell (e.g., T cell, NK cell) product.

In an embodiment, a subject is pre-treated with one or more therapies that reduce TREG cells prior to collection of cells for fusion polypeptide, e.g., as described herein, comprising a domain that includes a CAR, -expressing cell product manufacturing, thereby reducing the risk of subject relapse to fusion polypeptide, e.g., as described herein, comprising a domain that includes a CAR, -expressing cell treatment. In an embodiment, methods of decreasing TREG cells include, but are not limited to, administration to the subject of one or more of cyclophosphamide, anti-GITR antibody, CD25-depletion, or a combination thereof. Administration of one or more of cyclophosphamide, anti-GITR antibody, CD25-depletion, or a combination thereof, can occur before, during or after an infusion of the CAR-expressing cell product.

In an embodiment, a subject is pre-treated with cyclophosphamide prior to collection of cells for CAR-expressing cell product manufacturing, thereby reducing the risk of subject relapse to fusion polypeptide, e.g., as described herein, comprising a domain that includes a CAR, -expressing cell treatment. In an embodiment, a subject is pre-treated with an anti-GITR antibody prior to collection of cells for CAR-expressing cell product manufacturing, thereby reducing the risk of subject relapse to CAR-expressing cell treatment.

In one embodiment, the population of cells to be removed are neither the regulatory T cells or tumor cells, but cells that otherwise negatively affect the expansion and/or function of CART cells, e.g. cells expressing CD14, CD11b, CD33, CD15, or other markers expressed by potentially immune suppressive cells. In one embodiment, such cells are envisioned to be removed concurrently with regulatory T cells and/or tumor cells, or following said depletion, or in another order.

The methods described herein can include more than one selection step, e.g., more than one depletion step. Enrichment of a T cell population by negative selection can be accomplished, e.g., with a combination of antibodies directed to surface markers unique to the negatively selected cells. One method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail can include antibodies to CD14, CD20, CD11b, CD16, HLA-DR, and CD8.

The methods described herein can further include removing cells from the population which express a tumor antigen, e.g., a tumor antigen that does not comprise CD25, e.g., CD19, CD30, CD38, CD123, CD20, CD14 or CD11b, to thereby provide a population of T regulatory depleted, e.g., CD25+ depleted, and tumor antigen depleted cells that are suitable for expression of a fusion polypeptide, e.g., as described herein, comprising a domain that includes a CAR, e.g., a CAR described herein. In one embodiment, tumor antigen expressing cells are removed simultaneously with the T regulatory, e.g., CD25+ cells. For example, an anti-CD25 antibody, or fragment thereof, and an anti-tumor antigen antibody, or fragment thereof, can be attached to the same substrate, e.g., bead, which can be used to remove the cells or an anti-CD25 antibody, or fragment thereof, or the anti-tumor antigen antibody, or fragment thereof, can be attached to separate beads, a mixture of which can be used to remove the cells. In other embodiments, the removal of T regulatory cells, e.g., CD25+ cells, and the removal of the tumor antigen expressing cells is sequential, and can occur, e.g., in either order.

Also provided are methods that include removing cells from the population which express a check point inhibitor, e.g., a check point inhibitor described herein, e.g., one or more of PD1+ cells, LAG3+ cells, and TIM3+ cells, to thereby provide a population of T regulatory depleted, e.g., CD25+ depleted cells, and check point inhibitor depleted cells, e.g., PD1+, LAG3+ and/or TIM3+ depleted cells. Exemplary check point inhibitors include B7-H1, B7-1, CD160, P1H, 2B4, PD1, TIM3, CEACAM (e.g., CEACAM-1, CEACAM-3 and/or CEACAM-5), LAG3, TIGIT, CTLA-4, BTLA and LAIR1. In one embodiment, check point inhibitor expressing cells are removed simultaneously with the T regulatory, e.g., CD25+ cells. For example, an anti-CD25 antibody, or fragment thereof, and an anti-check point inhibitor antibody, or fragment thereof, can be attached to the same bead which can be used to remove the cells, or an anti-CD25 antibody, or fragment thereof, and the anti-check point inhibitor antibody, or fragment there, can be attached to separate beads, a mixture of which can be used to remove the cells. In other embodiments, the removal of T regulatory cells, e.g., CD25+ cells, and the removal of the check point inhibitor expressing cells is sequential, and can occur, e.g., in either order.

Methods described herein can include a positive selection step. For example, T cells can isolated by incubation with anti-CD3/anti-CD28 (e.g., 3×28)-conjugated beads, such as DYNABEADS® M-450 CD3/CD28 T, for a time period sufficient for positive selection of the desired T cells. In one embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another embodiment, the time period is 10 to 24 hours, e.g., 24 hours. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells. Thus, by simply shortening or lengthening the time T cells are allowed to bind to the CD3/CD28 beads and/or by increasing or decreasing the ratio of beads to T cells (as described further herein), subpopulations of T cells can be preferentially selected for or against at culture initiation or at other time points during the process. Additionally, by increasing or decreasing the ratio of anti-CD3 and/or anti-CD28 antibodies on the beads or other surface, subpopulations of T cells can be preferentially selected for or against at culture initiation or at other desired time points.

In one embodiment, a T cell population can be selected that expresses one or more of IFN-γ, TNFα, IL-17A, IL-2, IL-3, IL-4, GM-CSF, IL-10, IL-13, granzyme B, and perforin, or other appropriate molecules, e.g., other cytokines. Methods for screening for cell expression can be determined, e.g., by the methods described in PCT Publication No.: WO 2013/126712.

For isolation of a desired population of cells by positive or negative selection, the concentration of cells and surface (e.g., particles such as beads) can be varied. In certain aspects, it may be desirable to significantly decrease the volume in which beads and cells are mixed together (e.g., increase the concentration of cells), to ensure maximum contact of cells and beads. For example, in one aspect, a concentration of 10 billion cells/ml, 9 billion/ml, 8 billion/ml, 7 billion/ml, 6 billion/ml, or 5 billion/ml is used. In one aspect, a concentration of 1 billion cells/ml is used. In yet one aspect, a concentration of cells from 75, 80, 85, 90, 95, or 100 million cells/ml is used. In further aspects, concentrations of 125 or 150 million cells/ml can be used.

Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (e.g., leukemic blood, tumor tissue, etc.). Such populations of cells may have therapeutic value and would be desirable to obtain. For example, using high concentration of cells allows more efficient selection of CD8+ T cells that normally have weaker CD28 expression.

In a related aspect, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one aspect, the concentration of cells used is $5\times10^6$/ml. In other aspects, the concentration used can be from about $1\times10^5$/ml to $1\times10^6$/ml, and any integer value in between.

In other aspects, the cells may be incubated on a rotator for varying lengths of time at varying speeds at either 2-10° C. or at room temperature.

T cells for stimulation can also be frozen after a washing step. Wishing not to be bound by theory, the freeze and subsequent thaw step provides a more uniform product by removing granulocytes and to some extent monocytes in the cell population. After the washing step that removes plasma and platelets, the cells may be suspended in a freezing solution. While many freezing solutions and parameters are known in the art and will be useful in this context, one method involves using PBS containing 20% DMSO and 8% human serum albumin, or culture media containing 10% Dextran 40 and 5% Dextrose, 20% Human Serum Albumin and 7.5% DMSO, or 31.25% Plasmalyte-A, 31.25% Dextrose 5%, 0.45% NaCl, 10% Dextran 40 and 5% Dextrose, 20% Human Serum Albumin, and 7.5% DMSO or other suitable cell freezing media containing for example, Hespan and PlasmaLyte A, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

In certain aspects, cryopreserved cells are thawed and washed as described herein and allowed to rest for one hour at room temperature prior to activation using the methods of the present invention.

Also contemplated in the context of the invention is the collection of blood samples or apheresis product from a subject at a time period prior to when the expanded cells as described herein might be needed. As such, the source of the cells to be expanded can be collected at any time point necessary, and desired cells, such as T cells, isolated and frozen for later use in immune effector cell therapy for any number of diseases or conditions that would benefit from immune effector cell therapy, such as those described herein. In one aspect a blood sample or an apheresis is taken from a generally healthy subject. In certain aspects, a blood sample or an apheresis is taken from a generally healthy subject who is at risk of developing a disease, but who has not yet developed a disease, and the cells of interest are isolated and frozen for later use. In certain aspects, the T cells may be expanded, frozen, and used at a later time. In certain aspects, samples are collected from a patient shortly after diagnosis of a particular disease as described herein but prior to any treatments. In a further aspect, the cells are isolated from a blood sample or an apheresis from a subject prior to any number of relevant treatment modalities, including but not limited to treatment with agents such as natalizumab, efalizumab, antiviral agents, chemotherapy, radiation, immunosuppressive agents, such as cyclosporin, azathioprine, methotrexate, mycophenolate, and FK506, antibodies, or other immunoablative agents such as CAMPATH, anti-CD3 antibodies, cytoxan, fludarabine, cyclosporin, FK506, rapamycin, mycophenolic acid, steroids, FR901228, and irradiation.

In a further aspect of the present invention, T cells are obtained from a patient directly following treatment that leaves the subject with functional T cells. In this regard, it has been observed that following certain cancer treatments, in particular treatments with drugs that damage the immune system, shortly after treatment during the period when patients would normally be recovering from the treatment, the quality of T cells obtained may be optimal or improved for their ability to expand ex vivo. Likewise, following ex vivo manipulation using the methods described herein, these cells may be in a preferred state for enhanced engraftment and in vivo expansion. Thus, it is contemplated within the context of the present disclosure to collect blood cells, including T cells, dendritic cells, or other cells of the hematopoietic lineage, during this recovery phase. Further, in certain aspects, mobilization (for example, mobilization with GM-CSF) and conditioning regimens can be used to create a condition in a subject wherein repopulation, recirculation, regeneration, and/or expansion of particular cell types is favored, especially during a defined window of time following therapy. Illustrative cell types include T cells, B cells, dendritic cells, and other cells of the immune system.

In one embodiment, the immune effector cells expressing a fusion polypeptide, e.g., as described herein, comprising a domain that includes a CAR molecule, e.g., a CAR molecule described herein, are obtained from a subject that has received a low, immune enhancing dose of an mTOR inhibitor. In an embodiment, the population of immune effector cells, e.g., T cells, to be engineered to express a CAR, are harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In other embodiments, population of immune effector cells, e.g., T cells, which have, or will be engineered to express a fusion protein, e.g., as described herein, comprising a domain that includes a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In one embodiment, a T cell population is diaglycerol kinase (DGK)-deficient. DGK-deficient cells include cells that do not express DGK RNA or protein, or have reduced or inhibited DGK activity. DGK-deficient cells can be generated by genetic approaches, e.g., administering RNA-interfering agents, e.g., siRNA, shRNA, miRNA, to reduce or prevent DGK expression. Alternatively, DGK-deficient cells can be generated by treatment with DGK inhibitors described herein.

In one embodiment, a T cell population is Ikaros-deficient. Ikaros-deficient cells include cells that do not express Ikaros RNA or protein, or have reduced or inhibited Ikaros activity, Ikaros-deficient cells can be generated by genetic approaches, e.g., administering RNA-interfering agents, e.g., siRNA, shRNA, miRNA, to reduce or prevent Ikaros expression. Alternatively, Ikaros-deficient cells can be generated by treatment with Ikaros inhibitors, e.g., lenalidomide.

In embodiments, a T cell population is DGK-deficient and Ikaros-deficient, e.g., does not express DGK and Ikaros, or has reduced or inhibited DGK and Ikaros activity. Such DGK and Ikaros-deficient cells can be generated by any of the methods described herein.

In an embodiment, the NK cells are obtained from the subject. In another embodiment, the NK cells are an NK cell line, e.g., NK-92 cell line (Conkwest).

Additional Expressed Agents

In another embodiment, a fusion polypeptide, e.g., as described herein, comprising a domain that includes a CAR, -expressing immune effector cell described herein can further express another agent, e.g., an agent which enhances the activity of a CAR-expressing cell. For example, in one embodiment, the agent can be an agent which inhibits an inhibitory molecule. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGFR beta, e.g., as described herein. In one embodiment, the agent that inhibits an inhibitory molecule comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGFR beta, or a fragment of any of these, and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28, CD27, OX40 or 4-IBB signaling domain described herein and/or a CD3 zeta signaling domain described herein).

In one embodiment, the fusion polypeptide, e.g., as described herein, comprising a domain that includes a CAR, -expressing immune effector cell described herein can further comprise a second fusion polypeptide, e.g., as described herein, comprising a domain that includes a CAR, e.g., a second CAR that includes a different antigen binding domain, e.g., to the same target (e.g., a target described above) or a different target. In one embodiment, the second CAR includes an antigen binding domain to a target expressed on the same cancer cell type as the target of the first CAR. In one embodiment, the CAR-expressing immune effector cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain.

While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing immune effector cell comprises a first CAR that includes an antigen binding domain that targets, e.g., a target described above, a transmembrane domain and a costimulatory domain and a second CAR that targets an antigen other than antigen targeted by the first CAR (e.g., an antigen expressed on the same cancer cell type as the first target) and includes an antigen binding domain, a transmembrane domain and a primary signaling domain. In another embodiment, the CAR expressing immune effector cell comprises a first CAR that includes an antigen binding domain that targets, e.g., a target described above, a transmembrane domain and a primary signaling domain and a second CAR that targets an antigen other than antigen targeted by the first CAR (e.g., an antigen expressed on the same cancer cell type as the first target) and includes an antigen binding domain to the antigen, a transmembrane domain and a costimulatory signaling domain.

In one embodiment, the CAR-expressing immune effector cell comprises a CAR described herein, e.g., a CAR to a target described above, and an inhibitory CAR. In one embodiment, the inhibitory CAR comprises an antigen binding domain that binds an antigen found on normal cells but not cancer cells, e.g., normal cells that also express the target. In one embodiment, the inhibitory CAR comprises the antigen binding domain, a transmembrane domain and an intracellular domain of an inhibitory molecule. For example, the intracellular domain of the inhibitory CAR can be an intracellular domain of PD1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGFR beta.

In one embodiment, an immune effector cell (e.g., T cell, NK cell) comprises a first CAR comprising an antigen binding domain that binds to a tumor antigen as described herein, and a second CAR comprising a PD1 extracellular domain or a fragment thereof.

In one embodiment, the cell further comprises an inhibitory molecule as described above.

In one embodiment, the second CAR in the cell is an inhibitory CAR, wherein the inhibitory CAR comprises an antigen binding domain, a transmembrane domain, and an intracellular domain of an inhibitory molecule. The inhibitory molecule can be chosen from one or more of: PD1, PD-L1, CTLA-4, TIM-3, LAG-3, VISTA, BTLA, TIGIT, LAIR1, CD160, 2B4, TGFR beta, CEACAM-1, CEACAM-3, and CEACAM-5. In one embodiment, the second CAR molecule comprises the extracellular domain of PD1 or a fragment thereof.

In embodiments, the second CAR molecule in the cell further comprises an intracellular signaling domain comprising a primary signaling domain and/or an intracellular signaling domain.

In other embodiments, the intracellular signaling domain in the cell comprises a primary signaling domain comprising the functional domain of CD3 zeta and a costimulatory signaling domain comprising the functional domain of 4-1BB.

In certain embodiments, the antigen binding domain of the first CAR molecule comprises a scFv and the antigen binding domain of the second CAR molecule does not comprise a scFv. For example, the antigen binding domain of the first CAR molecule comprises a scFv and the antigen binding domain of the second CAR molecule comprises a camelid VHH domain.

Split CAR

In some embodiments, the CAR-expressing cell uses a split CAR. The split CAR approach is described in more detail in publications WO2014/055442 and WO2014/055657, herein incorporated by reference. Briefly, a split CAR system comprises a cell expressing a first CAR having a first antigen binding domain and a costimulatory domain (e.g., 41BB), and the cell also expresses a second CAR having a second antigen binding domain and an intracellular signaling domain (e.g., CD3 zeta). When the cell encounters the first antigen, the costimulatory domain is activated, and the cell proliferates. When the cell encounters the second antigen, the intracellular signaling domain is activated and cell-killing activity begins. Thus, the CAR-expressing cell is only fully activated in the presence of both antigens.

Multiple CAR Expression

In one aspect, the fusion polypeptide, e.g., as described herein, comprising a domain that includes a CAR, -expressing cell described herein can further comprise a second fusion polypeptide, e.g., as described herein, comprising a domain that includes a CAR, e.g., a second CAR that includes a different antigen binding domain, e.g., to the same target or a different target (e.g., a target other than a cancer associated antigen described herein or a different cancer associated antigen described herein). In one embodiment, the second CAR includes an antigen binding domain to a target expressed the same cancer cell type as the cancer associated antigen. In one embodiment, the CAR-expressing cell comprises a first CAR that targets a first antigen and includes an intracellular signaling domain having a costimulatory signaling domain but not a primary signaling domain, and a second CAR that targets a second, different, antigen and includes an intracellular signaling domain having a primary signaling domain but not a costimulatory signaling domain. While not wishing to be bound by theory, placement of a costimulatory signaling domain, e.g., 4-1BB, CD28, CD27 or OX-40, onto the first CAR, and the primary signaling domain, e.g., CD3 zeta, on the second CAR can limit the CAR activity to cells where both targets are expressed. In one embodiment, the CAR expressing cell comprises a first cancer associated antigen CAR that includes an antigen binding domain that binds a target antigen described herein, a transmembrane domain and a costimulatory domain and a second CAR that targets a different target antigen (e.g., an antigen expressed on that same cancer cell type as the first target antigen) and includes an antigen binding domain, a transmembrane domain and a primary signaling domain. In another embodiment, the CAR expressing cell comprises a first CAR that includes an antigen binding domain that binds a target antigen described herein, a transmembrane domain and a primary signaling domain and a second CAR that targets an antigen other than the first target antigen (e.g., an antigen expressed on the same cancer cell type as the first target antigen) and includes an antigen binding domain to the antigen, a transmembrane domain and a costimulatory signaling domain.

In some embodiments, the claimed invention comprises a first and second CAR, wherein the antigen binding domain of one of said first CAR said second CAR does not comprise a variable light domain and a variable heavy domain. In some embodiments, the antigen binding domain of one of said first CAR said second CAR is an scFv, and the other is not an scFv. In some embodiments, the antigen binding domain of one of said first CAR said second CAR comprises a single VH domain, e.g., a camelid, shark, or lamprey single VH domain, or a single VH domain derived from a human or mouse sequence. In some embodiments, the antigen binding domain of one of said first CAR said second CAR comprises a nanobody. In some embodiments, the antigen binding domain of one of said first CAR said second CAR comprises a camelid VHH domain.

Allogeneic Cells

In embodiments described herein, the immune effector cell can be an allogeneic immune effector cell, e.g., T cell or NK cell. For example, the cell can be an allogeneic T cell, e.g., an allogeneic T cell lacking expression of a functional T cell receptor (TCR) and/or human leukocyte antigen (HLA), e.g., HLA class I and/or HLA class II or beta 2 microglobulin (B2M).

A T cell lacking a functional TCR can be, e.g., engineered such that it does not express any functional TCR on its surface, engineered such that it does not express one or more subunits that comprise a functional TCR, e.g., TRAC, TRBC1, TRBC2, CD3E, CD3G, or CD3D, or engineered such that it produces very little functional TCR on its surface. Alternatively, the T cell can express a substantially impaired TCR, e.g., by expression of mutated or truncated forms of one or more of the subunits of the TCR. The term "substantially impaired TCR" means that this TCR will not elicit an adverse immune reaction in a host.

A T cell described herein can be, e.g., engineered such that it does not express a functional HLA on its surface. For example, a T cell described herein, can be engineered such that cell surface expression HLA, e.g., HLA class 1 and/or HLA class II, or subunit or regulator of HLA expression, e.g., B2M, is downregulated.

A T cell described herein can be, e.g., engineered such that it does not express a functional B2M on its surface. For example, a T cell described herein, can be engineered such that cell surface expression of B2M is downregulated.

In some embodiments, the T cell can lack a functional TCR and a functional HLA, e.g., HLA class I and/or HLA class II.

Modified T cells that lack expression of a functional TCR and/or HLA can be obtained by any suitable means, including a knock out or knock down of one or more subunit of TCR or HLA. For example, the T cell can include a knock down of TCR and/or HLA using siRNA, shRNA, clustered regularly interspaced short palindromic repeats (CRISPR) transcription-activator like effector nuclease (TALEN), or zinc finger endonuclease (ZFN).

In some embodiments, the allogeneic cell can be a cell which does not express or expresses at low levels an inhibitory molecule, e.g. by any method described herein. For example, the cell can be a cell that does not express or expresses at low levels an inhibitory molecule, e.g., that can decrease the ability of a CAR-expressing cell to mount an immune effector response. Examples of inhibitory molecules include PD1, PD-L1, CTLA4, TIM3, CEACAM (e.g., CEACAM-1, CEACAM-3 and/or CEACAM-5), LAG3, VISTA, BTLA, TIGIT, LAIR1, CD160, 2B4 and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used.

siRNA and shRNA

In some embodiments, TCR expression and/or HLA or B2M expression can be inhibited using siRNA or shRNA that targets a nucleic acid encoding a TCR and/or HLA in a T cell.

CRISPR

"CRISPR" or "CRISPR to TCR and/or HLA" or "CRISPR to inhibit TCR and/or HLA" as used herein refers to a set of clustered regularly interspaced short palindromic repeats, or a system comprising such a set of repeats. "Cas", as used herein, refers to a CRISPR-associated protein. A "CRISPR/Cas" system refers to a system derived from CRISPR and Cas which can be used to silence or mutate a TCR and/or HLA or B2M gene.

Artificial CRISPR/Cas systems can be generated which inhibit TCR and/or HLA, using technology known in the art, e.g., that described in U.S. Publication No. 20140068797, and Cong (2013) Science 339: 819-823, herein incorporated by reference in their entireties. Other artificial CRISPR/Cas systems that are known in the art may also be generated which inhibit TCR and/or HLA, e.g., that described in Tsai (2014) Nature Biotechnol., 32:6 569-576, U.S. Pat. Nos. 8,871,445; 8,865,406; 8,795,965; 8,771,945; and 8,697,359, herein incorporated by reference in their entireties.

TALEN

"TALEN" or "TALEN to HLA and/or TCR" or "TALEN to inhibit HLA and/or TCR" refers to a transcription activator-like effector nuclease, an artificial nuclease which can be used to edit the HLA or B2M and/or TCR gene.

TALENs are produced artificially by fusing a TAL effector DNA binding domain to a DNA cleavage domain Transcription activator-like effects (TALEs) can be engineered to bind any desired DNA sequence, including a portion of the HLA or TCR gene. By combining an engineered TALE with a DNA cleavage domain, a restriction enzyme can be produced which is specific to any desired DNA sequence, including a HLA or TCR sequence. These can then be introduced into a cell, wherein they can be used for genome editing, as described in Boch (2011) Nature Biotech. 29: 135-6; Boch et al. (2009) Science 326: 1509-12; and Moscou et al. (2009) Science 326: 3501, herein incorporated by reference in their entireties.

TALENs specific to sequences in HLA or TCR can be constructed using any method known in the art, including various schemes using modular components, as described in Zhang et al. (2011) Nature Biotech. 29: 149-53; and Geibler et al. (2011) PLoS ONE 6: e19509, herein incorporated by reference in their entireties.

Zinc Finger Nuclease to Inhibit HLA and/or TCR

"ZFN" or "Zinc Finger Nuclease" or "ZFN to HLA and/or TCR" or "ZFN to inhibit HLA and/or TCR" refer to a zinc finger nuclease, an artificial nuclease which can be used to edit the HLA and/or TCR or B2M gene.

ZFNs specific to sequences in HLA AND/OR TCR can be constructed using any method known in the art, as described in Provasi (2011) Nature Med. 18: 807-815; Torikai (2013) Blood 122: 1341-1349; Cathomen et al. (2008) Mol. Ther. 16: 1200-7; Guo et al. (2010) J. Mol. Biol. 400: 96; U.S. Patent Publication 2011/0158957; and U.S. Patent Publication 2012/0060230, herein incorporated by reference in their entireties.

Telomerase Expression

While not wishing to be bound by any particular theory, in some embodiments, a therapeutic T cell has short term persistence in a patient, due to shortened telomeres in the T cell; accordingly, transfection with a telomerase gene can lengthen the telomeres of the T cell and improve persistence of the T cell in the patient. See Carl June, "Adoptive T cell therapy for cancer in the clinic", Journal of Clinical Investigation, 117:1466-1476 (2007), herein incorporated by reference in its entirety. Thus, in an embodiment, an immune effector cell, e.g., a T cell, ectopically expresses a telomerase subunit, e.g., the catalytic subunit of telomerase, e.g., TERT, e.g., hTERT. In some aspects, this disclosure provides a method of producing a CAR-expressing cell, comprising contacting a cell with a nucleic acid encoding a telomerase subunit, e.g., the catalytic subunit of telomerase, e.g., TERT, e.g., hTERT. The cell may be contacted with the nucleic acid before, simultaneous with, or after being contacted with a construct encoding a CAR.

Expansion and Activation

Immune effector cells such as T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005, each of which is incorporated by reference in its entirety.

Generally, a population of immune effector cells e.g., T regulatory cell depleted cells, may be expanded by contact with a surface having attached thereto an agent that stimulates a CD3/TCR complex associated signal and a ligand that stimulates a costimulatory molecule on the surface of the T cells. In particular, T cell populations may be stimulated as described herein, such as by contact with an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. To stimulate proliferation of either CD4+ T cells or CD8+ T cells, an anti-CD3 antibody and an anti-CD28 antibody can be used. Examples of an anti-CD28 antibody include 9.3, B-T3, XR-CD28 (Diaclone, Besancon, France) can be used as can other methods commonly known in the art (Berg et al., Transplant Proc. 30(8):3975-3977, 1998; Haanen et al., J. Exp. Med. 190(9):13191328, 1999; Garland et al., J Immunol Meth. 227(1-2):53-63, 1999).

In certain aspects, the primary stimulatory signal and the costimulatory signal for the T cell may be provided by different protocols. For example, the agents providing each signal may be in solution or coupled to a surface. When coupled to a surface, the agents may be coupled to the same surface (i.e., in "cis" formation) or to separate surfaces (i.e., in "trans" formation). Alternatively, one agent may be coupled to a surface and the other agent in solution. In one aspect, the agent providing the costimulatory signal is bound to a cell surface and the agent providing the primary activation signal is in solution or coupled to a surface. In certain aspects, both agents can be in solution. In one aspect, the agents may be in soluble form, and then cross-linked to a surface, such as a cell expressing Fc receptors or an antibody or other binding agent which will bind to the agents. In this regard, see for example, U.S. Patent Application Publication Nos. 20040101519 and 20060034810 for artificial antigen presenting cells (aAPCs) that are contemplated for use in activating and expanding T cells in the present invention, herein incorporated by reference in their entireties.

In one aspect, the two agents are immobilized on beads, either on the same bead, i.e., "cis," or to separate beads, i.e., "trans." By way of example, the agent providing the primary activation signal is an anti-CD3 antibody or an antigen-binding fragment thereof and the agent providing the costimulatory signal is an anti-CD28 antibody or antigen-binding fragment thereof; and both agents are co-immobilized to the same bead in equivalent molecular amounts. In one aspect, a 1:1 ratio of each antibody bound to the beads for CD4+ T cell expansion and T cell growth is used. In certain aspects of the present invention, a ratio of anti CD3:CD28 antibodies bound to the beads is used such that an increase in T cell expansion is observed as compared to the expansion observed using a ratio of 1:1. In one particular aspect an increase of from about 1 to about 3-fold is observed as compared to the expansion observed using a ratio of 1:1. In one aspect, the ratio of CD3:CD28 antibody bound to the beads ranges from 100:1 to 1:100 and all integer values there between. In one aspect, more anti-CD28 antibody is bound to the particles than anti-CD3 antibody, i.e., the ratio of CD3:CD28 is less than one. In certain aspects, the ratio of anti CD28 antibody to anti CD3 antibody bound to the beads is greater than 2:1. In one particular aspect, a 1:100 CD3:CD28 ratio of antibody bound to beads is used. In one aspect, a 1:75 CD3:CD28 ratio of antibody bound to beads is used. In a further aspect, a 1:50 CD3:CD28 ratio of antibody bound to beads is used. In one aspect, a 1:30 CD3:CD28 ratio of antibody bound to beads is used. In one preferred aspect, a 1:10 CD3:CD28 ratio of antibody bound to beads is used. In one aspect, a 1:3 CD3:CD28 ratio of antibody bound to the beads is used. In yet one aspect, a 3:1 CD3:CD28 ratio of antibody bound to the beads is used.

Ratios of particles to cells from 1:500 to 500:1 and any integer values in between may be used to stimulate T cells or other target cells. As those of ordinary skill in the art can readily appreciate, the ratio of particles to cells may depend on particle size relative to the target cell. For example, small sized beads could only bind a few cells, while larger beads could bind many. In certain aspects the ratio of cells to particles ranges from 1:100 to 100:1 and any integer values in-between and in further aspects the ratio comprises 1:9 to 9:1 and any integer values in between, can also be used to stimulate T cells. The ratio of anti-CD3- and anti-CD28-coupled particles to T cells that result in T cell stimulation can vary as noted above, however certain preferred values include 1:100, 1:50, 1:40, 1:30, 1:20, 1:10, 1:9, 1:8, 1:7, 1:6, 1:5, 1:4, 1:3, 1:2, 1:1, 2:1, 3:1, 4:1, 5:1, 6:1, 7:1, 8:1, 9:1, 10:1, and 15:1 with one preferred ratio being at least 1:1 particles per T cell. In one aspect, a ratio of particles to cells of 1:1 or less is used. In one particular aspect, a preferred particle: cell ratio is 1:5. In further aspects, the ratio of particles to cells can be varied depending on the day of stimulation. For example, in one aspect, the ratio of particles to cells is from 1:1 to 10:1 on the first day and additional particles are added to the cells every day or every other day thereafter for up to 10 days, at final ratios of from 1:1 to 1:10 (based on cell counts on the day of addition). In one particular aspect, the ratio of particles to cells is 1:1 on the first day of stimulation and adjusted to 1:5 on the third and fifth days of stimulation. In one aspect, particles are added on a daily or every other day basis to a final ratio of 1:1 on the first day, and 1:5 on the third and fifth days of stimulation. In one aspect, the ratio of particles to cells is 2:1 on the first day of stimulation and adjusted to 1:10 on the third and fifth days of stimulation. In one aspect, particles are added on a daily or every other day basis to a final ratio of 1:1 on the first day, and 1:10 on the third and fifth days of stimulation. One of skill in the art will appreciate that a variety of other ratios may be suitable for use in the present invention. In particular, ratios will vary depending on particle size and on cell size and type. In one aspect, the most typical ratios for use are in the neighborhood of 1:1, 2:1 and 3:1 on the first day.

In further aspects, the cells, such as T cells, are combined with agent-coated beads, the beads and the cells are subsequently separated, and then the cells are cultured. In an alternative aspect, prior to culture, the agent-coated beads and cells are not separated but are cultured together. In a further aspect, the beads and cells are first concentrated by application of a force, such as a magnetic force, resulting in increased ligation of cell surface markers, thereby inducing cell stimulation.

By way of example, cell surface proteins may be ligated by allowing paramagnetic beads to which anti-CD3 and anti-CD28 are attached (3×28 beads) to contact the T cells. In one aspect the cells (for example, $10^4$ to $10^9$ T cells) and beads (for example, DYNABEADS® M-450 CD3/CD28 T paramagnetic beads at a ratio of 1:1) are combined in a buffer, for example PBS (without divalent cations such as, calcium and magnesium). Again, those of ordinary skill in the art can readily appreciate any cell concentration may be used. For example, the target cell may be very rare in the sample and comprise only 0.01% of the sample or the entire sample (i.e., 100%) may comprise the target cell of interest. Accordingly, any cell number is within the context of the present invention. In certain aspects, it may be desirable to significantly decrease the volume in which particles and cells are mixed together (i.e., increase the concentration of cells), to ensure maximum contact of cells and particles. For example, in one aspect, a concentration of about 10 billion cells/ml, 9 billion/ml, 8 billion/ml, 7 billion/ml, 6 billion/ml, 5 billion/ml, or 2 billion cells/ml is used. In one aspect, greater than 100 million cells/ml is used. In a further aspect, a concentration of cells of 10, 15, 20, 25, 30, 35, 40, 45, or 50 million cells/ml is used. In yet one aspect, a concentration of cells from 75, 80, 85, 90, 95, or 100 million cells/ml is used. In further aspects, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells. Such populations of cells may have therapeutic value and would be desirable to obtain in certain aspects. For example, using high concentration of cells allows more efficient selection of CD8+ T cells that normally have weaker CD28 expression.

In one embodiment, cells transduced with a nucleic acid encoding a fusion polypeptide, e.g., as described herein, comprising a domain that includes a CAR, e.g., a CAR described herein, are expanded, e.g., by a method described herein. In one embodiment, the cells are expanded in culture for a period of several hours (e.g., about 2, 3, 4, 5, 6, 7, 8, 9, 10, 15, 18, 21 hours) to about 14 days (e.g., 1, 2, 3, 4, 5, 6, 7, 8, 9, 10, 11, 12, 13 or 14 days). In one embodiment, the cells are expanded for a period of 4 to 9 days. In one embodiment, the cells are expanded for a period of 8 days or less, e.g., 7, 6 or 5 days. In one embodiment, the cells are expanded in culture for 5 days, and the resulting cells are more potent than the same cells expanded in culture for 9 days under the same culture conditions. Potency can be defined, e.g., by various T cell functions, e.g. proliferation, target cell killing, cytokine production, activation, migration, or combinations thereof. In one embodiment, the cells are expanded for 5 days show at least a one, two, three or four fold increase in cells doublings upon antigen stimulation as compared to the same cells expanded in culture for 9 days under the same culture conditions. In one embodiment, the cells are expanded in culture for 5 days, and the resulting cells exhibit higher proinflammatory cytokine production, e.g., IFN-γ and/or GM-CSF levels, as compared to the same cells expanded in culture for 9 days under the same culture conditions. In one embodiment, the cells expanded for 5 days show at least a one, two, three, four, five, ten fold or more increase in pg/ml of proinflammatory cytokine production, e.g., IFN-γ and/or GM-CSF levels, as compared to the same cells expanded in culture for 9 days under the same culture conditions.

Several cycles of stimulation may also be desired such that culture time of T cells can be 60 days or more. Conditions appropriate for T cell culture include an appropriate media (e.g., Minimal Essential Media or RPMI Media 1640 or, X-vivo 15, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-12, IL-15, TGFβ, and TNF-α or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, AIM-V, DMEM, MEM, α-MEM, F-12, X-Vivo 15, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$).

In one embodiment, the cells are expanded in an appropriate media (e.g., media described herein) that includes one or more interleukin that result in at least a 200-fold (e.g., 200-fold, 250-fold, 300-fold, 350-fold) increase in cells over a 14 day expansion period, e.g., as measured by a method described herein such as flow cytometry. In one embodiment, the cells are expanded in the presence of IL-15 and/or IL-7 (e.g., IL-15 and IL-7).

In embodiments, methods described herein, e.g., fusion polypeptide, e.g., as described herein, comprising a domain that includes a CAR, -expressing cell manufacturing methods, comprise removing T regulatory cells, e.g., CD25+ T cells, from a cell population, e.g., using an anti-CD25 antibody, or fragment thereof, or a CD25-binding ligand, IL-2. Methods of removing T regulatory cells, e.g., CD25+ T cells, from a cell population are described herein. In embodiments, the methods, e.g., manufacturing methods, further comprise contacting a cell population (e.g., a cell population in which T regulatory cells, such as CD25+ T cells, have been depleted; or a cell population that has previously contacted an anti-CD25 antibody, fragment thereof, or CD25-binding ligand) with IL-15 and/or IL-7. For example, the cell population (e.g., that has previously contacted an anti-CD25 antibody, fragment thereof, or CD25-binding ligand) is expanded in the presence of IL-15 and/or IL-7.

In some embodiments a fusion polypeptide, e.g., as described herein, comprising a domain that includes a CAR, -expressing cell described herein is contacted with a composition comprising a interleukin-15 (IL-15) polypeptide, a interleukin-15 receptor alpha (IL-15Ra) polypeptide, or a combination of both a IL-15 polypeptide and a IL-15Ra polypeptide e.g., hetIL-15, during the manufacturing of the CAR-expressing cell, e.g., ex vivo. In embodiments, a CAR-expressing cell described herein is contacted with a composition comprising a IL-15 polypeptide during the manufacturing of the CAR-expressing cell, e.g., ex vivo. In embodiments, a CAR-expressing cell described herein is contacted with a composition comprising a combination of both a IL-15 polypeptide and a IL-15 Ra polypeptide during the manufacturing of the CAR-expressing cell, e.g., ex vivo. In embodiments, a CAR-expressing cell described herein is contacted with a composition comprising hetIL-15 during the manufacturing of the CAR-expressing cell, e.g., ex vivo.

In one embodiment the fusion polypeptide, e.g., as described herein, comprising a domain that includes a CAR, -expressing cell described herein is contacted with a composition comprising hetIL-15 during ex vivo expansion. In an embodiment, the CAR-expressing cell described herein is contacted with a composition comprising an IL-15 polypeptide during ex vivo expansion. In an embodiment, the CAR-expressing cell described herein is contacted with a composition comprising both an IL-15 polypeptide and an IL-15Ra polypeptide during ex vivo expansion. In one embodiment the contacting results in the survival and proliferation of a lymphocyte subpopulation, e.g., CD8+ T cells.

T cells that have been exposed to varied stimulation times may exhibit different characteristics. For example, typical blood or apheresed peripheral blood mononuclear cell products have a helper T cell population (TH, CD4+) that is greater than the cytotoxic or suppressor T cell population (TC, CD8+). Ex vivo expansion of T cells by stimulating CD3 and CD28 receptors produces a population of T cells that prior to about days 8-9 consists predominately of TH cells, while after about days 8-9, the population of T cells comprises an increasingly greater population of TC cells. Accordingly, depending on the purpose of treatment, infusing a subject with a T cell population comprising predominately of TH cells may be advantageous. Similarly, if an antigen-specific subset of TC cells has been isolated it may be beneficial to expand this subset to a greater degree.

Further, in addition to CD4 and CD8 markers, other phenotypic markers vary significantly, but in large part, reproducibly during the course of the cell expansion process. Thus, such reproducibility enables the ability to tailor an activated T cell product for specific purposes.

Once a fusion polypeptide, e.g., as described herein, comprising a domain that includes a CAR, described herein is constructed, various assays can be used to evaluate the activity of the molecule, such as but not limited to, the ability to expand T cells following antigen stimulation, sustain T cell expansion in the absence of re-stimulation, and anti-cancer activities in appropriate in vitro and animal models. Assays to evaluate the effects of a cars of the present disclosure are described in further detail below.

Western blot analysis of fusion polypeptide, e.g., as described herein, comprising a domain that includes a CAR, expression in primary T cells can be used to detect the presence of monomers and dimers. See, e.g., Milone et al., Molecular Therapy 17(8): 1453-1464 (2009). Very briefly, T cells (1:1 mixture of $CD4^+$ and $CD8^+$ T cells) expressing the CARs are expanded in vitro for more than 10 days followed by lysis and SDS-PAGE under reducing conditions. CARs containing the full length TCR-ζ cytoplasmic domain and the endogenous TCR-ζ chain are detected by western blotting using an antibody to the TCR-ζ chain. The same T cell subsets are used for SDS-PAGE analysis under non-reducing conditions to permit evaluation of covalent dimer formation.

In vitro expansion of fusion polypeptide$^+$, e.g., as described herein, comprising a domain that includes a CAR, e.g., $CAR^+$, T cells following antigen stimulation can be measured by flow cytometry. For example, a mixture of $CD4^+$ and $CD8^+$ T cells are stimulated with αCD3/αCD28 aAPCs followed by transduction with lentiviral vectors expressing GFP under the control of the promoters to be analyzed. Exemplary promoters include the CMV IE gene, EF-1α, ubiquitin C, or phosphoglycerokinase (PGK) promoters. GFP fluorescence is evaluated on day 6 of culture in the CD4+ and/or CD8+ T cell subsets by flow cytometry. See, e.g., Milone et al., Molecular Therapy 17(8): 1453-1464 (2009). Alternatively, a mixture of CD4+ and CD8+ T cells are stimulated with αCD3/αCD28 coated magnetic beads on day 0, and transduced with CAR on day 1 using a bicistronic lentiviral vector expressing CAR along with eGFP using a 2A ribosomal skipping sequence. Cultures are re-stimulated with either a cancer associated antigen as described herein+ K562 cells (K562 expressing a cancer associated antigen as described herein), wild-type K562 cells (K562 wild type) or K562 cells expressing hCD32 and 4-1BBL in the presence of antiCD3 and anti-CD28 antibody (K562-BBL-3/28) following washing. Exogenous IL-2 is added to the cultures every other day at 100 IU/ml. GFP+ T cells are enumerated by flow cytometry using bead-based counting. See, e.g., Milone et al., Molecular Therapy 17(8): 1453-1464 (2009).

Sustained fusion polypeptide+, e.g., as described herein, comprising a domain that includes a CAR, e.g., CAR+, T cell expansion in the absence of re-stimulation can also be measured. See, e.g., Milone et al., Molecular Therapy 17(8): 1453-1464 (2009). Briefly, mean T cell volume (fl) is measured on day 8 of culture using a Coulter Multisizer III particle counter, a Nexcelom Cellometer Vision or Millipore Scepter, following stimulation with αCD3/αCD28 coated magnetic beads on day 0, and transduction with the indicated CAR on day 1.

Animal models can also be used to measure a CART activity. For example, xenograft model using human a cancer associated antigen described herein-specific CAR+ T cells to treat a primary human pre-B ALL in immunodeficient mice can be used. See, e.g., Milone et al., Molecular Therapy 17(8): 1453-1464 (2009). Very briefly, after establishment of ALL, mice are randomized as to treatment groups. Different numbers of a cancer associated antigen-specific CARengineered T cells are coinjected at a 1:1 ratio into NOD-SCID-γ−/− mice bearing B-ALL. The number of copies of a cancer associated antigen-specific CAR vector in spleen DNA from mice is evaluated at various times following T cell injection.

Animals are assessed for leukemia at weekly intervals. Peripheral blood a cancer associate antigen as described herein+ B-ALL blast cell counts are measured in mice that are injected with a cancer associated antigen described herein-ζ CAR+ T cells or mock-transduced T cells. Survival curves for the groups are compared using the log-rank test. In addition, absolute peripheral blood CD4+ and CD8+ T cell counts 4 weeks following T cell injection in NOD-SCID-γ−/− mice can also be analyzed. Mice are injected with leukemic cells and 3 weeks later are injected with T cells engineered to express CAR by a bicistronic lentiviral vector that encodes the CAR linked to eGFP. T cells are normalized to 45-50% input GFP+ T cells by mixing with mock-transduced cells prior to injection, and confirmed by flow cytometry. Animals are assessed for leukemia at 1-week intervals. Survival curves for the CAR+ T cell groups are compared using the log-rank test.

Dose dependent fusion polypeptide, e.g., as described herein, comprising a domain that includes a CAR, treatment response can be evaluated. See, e.g., Milone et al., Molecular Therapy 17(8): 1453-1464 (2009). For example, peripheral blood is obtained 35-70 days after establishing leukemia in mice injected on day 21 with CAR T cells, an equivalent number of mock-transduced T cells, or no T cells. Mice from each group are randomly bled for determination of peripheral blood a cancer associate antigen as described herein+ ALL blast counts and then killed on days 35 and 49. The remaining animals are evaluated on days 57 and 70.

Assessment of cell proliferation and cytokine production has been previously described, e.g., at Milone et al., Molecular Therapy 17(8): 1453-1464 (2009). Briefly, assessment of CAR-mediated proliferation is performed in microtiter plates by mixing washed T cells with K562 cells expressing a cancer associated antigen described herein (K19) or CD32 and CD137 (KT32-BBL) for a final T-cell:K562 ratio of 2:1. K562 cells are irradiated with gamma-radiation prior to use. Anti-CD3 (clone OKT3) and anti-CD28 (clone 9.3) monoclonal antibodies are added to cultures with KT32-BBL cells to serve as a positive control for stimulating T-cell proliferation since these signals support long-term CD8+ T cell expansion ex vivo. T cells are enumerated in cultures using CountBright™ fluorescent beads (Invitrogen, Carlsbad, CA) and flow cytometry as described by the manufacturer. CAR+ T cells are identified by GFP expression using T cells that are engineered with eGFP-2A linked CAR-expressing lentiviral vectors. For CAR+ T cells not expressing GFP, the CAR+ T cells are detected with biotinylated recombinant a cancer associate antigen as described herein protein and a secondary avidin-PE conjugate. CD4+ and CD8+ expression on T cells are also simultaneously detected with specific monoclonal antibodies (BD Biosciences). Cytokine measurements are performed on supernatants collected 24 hours following re-stimulation using the human TH1/TH2 cytokine cytometric bead array kit (BD Biosciences, San Diego, CA) according the manufacturer's instructions. Fluorescence is assessed using a FACScalibur flow cytometer, and data is analyzed according to the manufacturer's instructions.

Cytotoxicity can be assessed by a standard 51Cr-release assay. See, e.g., Milone et al., Molecular Therapy 17(8): 1453-1464 (2009). Briefly, target cells (K562 lines and primary pro-B-ALL cells) are loaded with 51Cr (as NaCrO4, New England Nuclear, Boston, MA) at 37° C. for 2 hours with frequent agitation, washed twice in complete RPMI and plated into microtiter plates. Effector T cells are mixed with target cells in the wells in complete RPMI at varying ratios of effector cell:target cell (E:T). Additional wells containing media only (spontaneous release, SR) or a 1% solution of triton-X 100 detergent (total release, TR) are also prepared. After 4 hours of incubation at 37° C., supernatant from each well is harvested. Released 51Cr is then measured using a gamma particle counter (Packard Instrument Co., Waltham, MA). Each condition is performed in at least triplicate, and the percentage of lysis is calculated using the formula: % Lysis=(ER−SR)/(TR−SR), where ER represents the average 51Cr released for each experimental condition.

Imaging technologies can be used to evaluate specific trafficking and proliferation of CARs in tumor-bearing animal models. Such assays have been described, for example, in Barrett et al., Human Gene Therapy 22:1575-1586 (2011). Briefly, NOD/SCID/γc−/− (NSG) mice are injected IV with Nalm-6 cells followed 7 days later with T cells 4 hour after electroporation with the CAR constructs. The T cells are stably transfected with a lentiviral construct to express firefly luciferase, and mice are imaged for bioluminescence. Alternatively, therapeutic efficacy and specificity of a single injection of CAR+ T cells in Nalm-6 xenograft model can be measured as the following: NSG mice are injected with Nalm-6 transduced to stably express firefly luciferase, followed by a single tail-vein injection of T cells electroporated with cars of the present disclosure 7 days later. Animals are imaged at various time points post injection. For example, photon-density heat maps of firefly luciferasepositive leukemia in representative mice at day 5 (2 days before treatment) and day 8 (24 hr post CAR+ PBLs) can be generated.

Other assays, including those described in the Example section herein as well as those that are known in the art can also be used to evaluate the CARs described herein.

Methods of Making CAR-Expressing Cells

In another aspect, the invention pertains to a method of making a cell (e.g., an immune effector cell or population thereof) comprising introducing into (e.g., transducing) a cell, e.g., a T cell or a NK cell described herein, with a vector of comprising a nucleic acid encoding a fusion polypeptide, e.g., as described herein, comprising a domain that includes a CAR, e.g., a CAR described herein; or a nucleic acid encoding a CAR molecule e.g., a CAR described herein.

The cell in the methods is an immune effector cell (e.g., aT cell or a NK cell, or a combination thereof). In some embodiments, the cell in the methods is diaglycerol kinase (DGK) and/or Ikaros deficient.

In some embodiment, the introducing the nucleic acid molecule encoding a CAR comprises transducing a vector comprising the nucleic acid molecule encoding a fusion polypeptide, e.g., as described herein, comprising a domain that includes a CAR, or transfecting the nucleic acid molecule encoding a CAR, wherein the nucleic acid molecule is an in vitro transcribed RNA.

In some embodiments, the method further comprises:
providing a population of immune effector cells (e.g., T cells or NK cells); and
removing T regulatory cells from the population, thereby providing a population of T regulatory-depleted cells; wherein steps a) and b) are performed prior to introducing the nucleic acid encoding the fusion polypeptide, e.g., as described herein, comprising a domain that includes a CAR, to the population.

In embodiments of the methods, the T regulatory cells comprise CD25+ T cells, and are removed from the cell population using an anti-CD25 antibody, or fragment thereof. The anti-CD25 antibody, or fragment thereof, can be conjugated to a substrate, e.g., a bead.

In other embodiments, the population of T regulatory-depleted cells provided from step (b) contains less than 30%, 25%, 20%, 15%, 10%, 5%, 4%, 3%, 2%, 1% of CD25+ cells.

In yet other embodiments, the method further comprises removing cells from the population which express a tumor antigen that does not comprise CD25 to provide a population of T regulatory-depleted and tumor antigen depleted cells prior to introducing the nucleic acid encoding a fusion polypeptide, e.g., as described herein, comprising a domain that includes a CAR, to the population. The tumor antigen can be selected from CD19, CD30, CD38, CD123, CD20, CD14 or CD11b, or a combination thereof.

In other embodiments, the method further comprises removing cells from the population which express a checkpoint inhibitor, to provide a population of T regulatory-depleted and inhibitory molecule depleted cells prior to introducing the nucleic acid encoding a fusion polypeptide, e.g., as described herein, comprising a domain that includes a CAR, to the population. The checkpoint inhibitor can be chosen from PD-1, LAG-3, TIM3, B7-H1, CD160, P1H, 2B4, CEACAM (e.g., CEACAM-1, CEACAM-3, and/or CEACAM-5), TIGIT, CTLA-4, BTLA, and LAIR1.

Further embodiments disclosed herein encompass providing a population of immune effector cells. The population of immune effector cells provided can be selected based upon the expression of one or more of CD3, CD28, CD4, CD8, CD45RA, and/or CD45RO. In certain embodiments, the population of immune effector cells provided are CD3+ and/or CD28+.

In certain embodiments of the method, the method further comprises expanding the population of cells after the nucleic acid molecule encoding a fusion polypeptide, e.g., as described herein, comprising a domain that includes a CAR, has been introduced.

In embodiments, the population of cells is expanded for a period of 8 days or less.

In certain embodiments, the population of cells is expanded in culture for 5 days, and the resulting cells are more potent than the same cells expanded in culture for 9 days under the same culture conditions.

In other embodiments, the population of cells is expanded in culture for 5 days show at least a one, two, three or four fold increase in cell doublings upon antigen stimulation as compared to the same cells expanded in culture for 9 days under the same culture conditions.

In yet other embodiments, the population of cells is expanded in culture for 5 days, and the resulting cells exhibit higher proinflammatory IFN-γ and/or GM-CSF levels, as compared to the same cells expanded in culture for 9 days under the same culture conditions.

In other embodiments, the population of cells is expanded by culturing the cells in the presence of an agent that stimulates a CD3/TCR complex associated signal and/or a ligand that stimulates a costimulatory molecule on the surface of the cells. The agent can be a bead conjugated with anti-CD3 antibody, or a fragment thereof, and/or anti-CD28 antibody, or a fragment thereof.

In other embodiments, the population of cells is expanded in an appropriate media that includes one or more interleukin that result in at least a 200-fold, 250-fold, 300-fold, or 350-fold increase in cells over a 14 day expansion period, as measured by flow cytometry.

In other embodiments, the population of cells is expanded in the presence IL-15 and/or IL-7.

In certain embodiments, the method further includes cryopreserving the population of the cells after the appropriate expansion period.

In yet other embodiments, the method of making disclosed herein further comprises contacting the population of immune effector cells with a nucleic acid encoding a telomerase subunit, e.g., hTERT. The nucleic acid encoding the telomerase subunit can be DNA.

The present disclosure also provides a method of generating a population of RNA-engineered cells, e.g., cells described herein, e.g., immune effector cells (e.g., T cells, NK cells), transiently expressing exogenous RNA. The method comprises introducing an in vitro transcribed RNA or synthetic RNA into a cell, where the RNA comprises a nucleic acid encoding a fusion polypeptide, e.g., as described herein, comprising a domain that includes a CAR molecule, described herein.

In another aspect, the invention pertains to a method of providing an anti-tumor immunity in a subject comprising administering to the subject an effective amount of a cell comprising a fusion polypeptide, e.g., as described herein, comprising a domain that includes a CAR molecule, e.g., a cell expressing a CAR molecule described herein. In one embodiment, the cell is an autologous T cell or NK cell. In one embodiment, the cell is an allogeneic T cell or NK cell. In one embodiment, the subject is a human.

In one aspect, the invention includes a population of autologous cells that are transfected or transduced with a vector comprising a nucleic acid molecule encoding a fusion polypeptide, e.g., as described herein, comprising a domain that includes a CAR molecule, e.g., as described herein. In one embodiment, the vector is a retroviral vector. In one embodiment, the vector is a self-inactivating lentiviral vector as described elsewhere herein. In one embodiment, the vector is delivered (e.g., by transfecting or electroporating) to a cell, e.g., a T cell or a NK cell, wherein the vector comprises a nucleic acid molecule encoding a CAR of the present disclosure as described herein, which is transcribed as an mRNA molecule, and the CARs of the present disclosure is translated from the RNA molecule and expressed on the surface of the cell.

In another aspect, the present disclosure provides a population of fusion polypeptide, e.g., as described herein, comprising a domain that includes a CAR, -expressing cells, e.g., CAR-expressing immune effector cells (e.g., T cells or NK cells). In some embodiments, the population of CAR-expressing cells comprises a mixture of cells expressing different CARs. For example, in one embodiment, the population of CAR-expressing immune effector cells (e.g., T cells or NK cells) can include a first cell expressing a CAR having an antigen binding domain that binds to a first tumor antigen as described herein, and a second cell expressing a CAR having a different antigen binding domain that binds to a second tumor antigen as described herein. As another example, the population of CAR-expressing cells can include a first cell expressing a CAR that includes an antigen binding domain that binds to a tumor antigen as described herein, and a second cell expressing a CAR that includes an antigen binding domain to a target other than a tumor antigen as described herein. In one embodiment, the population of CAR-expressing cells includes, e.g., a first cell expressing a CAR that includes a primary intracellular signaling domain, and a second cell expressing a CAR that includes a secondary signaling domain, e.g., a costimulatory signaling domain.

In another aspect, the present disclosure provides a population of cells wherein at least one cell in the population expresses a fusion polypeptide, e.g., as described herein, comprising a domain that includes a CAR having an antigen binding domain that binds to a tumor antigen as described herein, and a second cell expressing another agent, e.g., an agent which enhances the activity of a CAR-expressing cell. For example, in one embodiment, the agent can be an agent which inhibits an inhibitory molecule. Examples of inhibitory molecules include PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGFR beta. In one embodiment, the agent which inhibits an inhibitory molecule, e.g., is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, LAG-3, CTLA-4, CD160, BTLA, LAIR1, TIM-3, CEACAM (e.g., CEACAM-1, CEACAM-3 and/or CEACAM-5), 2B4 and TIGIT, or a fragment of any of these, and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD-1 or a fragment thereof, and a second polypeptide of an intracellular signaling domain described herein (e.g., a CD28, CD27, OX40 or 4-IBB signaling domain described herein and/or a CD3 zeta signaling domain described herein).

In one embodiment, the nucleic acid molecule encoding a fusion polypeptide, e.g., as described herein, comprising a domain that includes a CAR of the present disclosure, e.g., as described herein, is expressed as an mRNA molecule. In one embodiment, the genetically modified CAR of the present invention-expressing cells, e.g., immune effector cells (e.g., T cells, NK cells), can be generated by transfecting or electroporating an RNA molecule encoding the desired CARs (e.g., without a vector sequence) into the cell. In one embodiment, a CAR of the present disclosure is translated from the RNA molecule once it is incorporated and expressed on the surface of the recombinant cell.

A method for generating mRNA for use in transfection involves in vitro transcription (IVT) of a template with specially designed primers, followed by polyA addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a polyA tail, typically 50-5000 bases in length (SEQ ID NO: 174). RNA so produced can efficiently transfect different kinds of cells. In one embodiment, the template includes sequences for the fusion polypeptide, e.g., as described herein, comprising a domain that includes a CAR. In an embodiment, an RNA fusion polypeptide, e.g., as described herein, comprising a domain that includes a CAR, vector is transduced into a cell, e.g., a T cell or a NK cell, by electroporation.

In one embodiment, the fusion polypeptide, e.g., as described herein, comprising a domain that includes a CAR, is introduced into immune effector cells (e.g., T cells, NK cells), e.g., using in vitro transcription, and the subject (e.g., human) receives an initial administration of fusion polypeptide, e.g., as described herein, comprising a domain that includes a CAR, immune effector cells (e.g., T cells, NK cells) of the invention, and one or more subsequent administrations of the fusion polypeptide, e.g., as described herein, comprising a domain that includes a CAR, immune effector cells (e.g., T cells, NK cells) of the invention, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR immune effector cells (e.g., T cells, NK cells) of the invention are administered to the subject (e.g., human) per week, e.g., 2, 3, or 4 administrations of the CAR immune effector cells (e.g., T cells, NK cells) of the invention are administered per week. In one embodiment, the subject (e.g., human subject) receives more than one administration of the CAR immune effector cells (e.g., T cells, NK cells) per week (e.g., 2, 3 or 4 administrations per week) (also referred to herein as a cycle), followed by a week of no CAR immune effector cells (e.g., T cells, NK cells) administrations, and then one or more additional administration of the CAR immune effector cells (e.g., T cells, NK cells) (e.g., more than one administration of the CAR immune effector cells (e.g., T cells, NK cells) per week) is administered to the subject. In another embodiment, the subject (e.g., human subject) receives more than one cycle of CAR immune effector cells (e.g., T cells, NK cells), and the time between each cycle is less than 10, 9, 8, 7, 6, 5, 4, or 3 days. In one embodiment, the CAR immune effector cells (e.g., T cells, NK cells) are administered every other day for 3 administrations per week. In one embodiment, the CAR immune effector cells (e.g., T cells, NK cells) of the invention are administered for at least two, three, four, five, six, seven, eight or more weeks.

In one aspect, CAR-expressing cells are generated using lentiviral viral vectors, such as lentivirus. Cells, e.g., CARTs, generated that way will have stable CAR expression.

In one aspect, CAR-expressing cells, e.g., CARTs, are generated using a viral vector such as a gammaretroviral vector, e.g., a gammaretroviral vector described herein. CARTs generated using these vectors can have stable CAR expression.

In one aspect, CARTs transiently express CAR vectors for 4, 5, 6, 7, 8, 9, 10, 11, 12, 13, 14, 15 days after transduction. Transient expression of CARs can be effected by RNA CAR vector delivery. In one aspect, the CAR RNA is transduced into the T cell by electroporation.

A potential issue that can arise in patients being treated using transiently expressing CAR immune effector cells (e.g., T cells, NK cells) (particularly with murine scFv bearing CARTs) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen day break in exposure to antigen. If a patient is at high risk of generating an anti-CAR antibody response during the course of transient CAR therapy (such as those generated by RNA transductions), CART infusion breaks should not last more than ten to fourteen days.

Pharmaceutical Composition

Pharmaceutical compositions of the present disclosure may comprise any fusion polypeptide, nucleic acid encoding such a fusion polypeptide, or cells comprising the fusion polypeptide, as described herein, and one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present disclosure are in one aspect formulated for intravenous administration.

Pharmaceutical compositions of the present disclosure may be administered in a manner appropriate to the disease to be treated (or prevented). The quantity and frequency of administration will be determined by such factors as the condition of the patient, and the type and severity of the patient's disease, although appropriate dosages may be determined by clinical trials.

In one aspect, the invention includes a pharmaceutical composition formulated for use in the method as described herein, the composition comprising a modified T cell comprising a nucleic acid encoding a suicide gene and a nucleic acid encoding a chimeric antigen receptor comprising an anti-B cell binding domain, a transmembrane domain, a costimulatory domain and an intracellular signaling domain.

In another aspect, the invention includes a pharmaceutical composition formulated for use in the method as described herein, the composition comprising a modified T cell comprising a nucleic acid encoding a dimerization domain and a chimeric antigen receptor (CAR) comprising an anti-B cell binding domain, a transmembrane domain, a costimulatory domain and an intracellular signaling domain.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-tumor effective amount," "a tumor-inhibiting effective amount," or "therapeutic amount" is indicated, the precise amount of the compositions of the present disclosureto be administered can be determined by a physician with consideration of individual differences in age, weight, tumor size, extent of infection or metastasis, and condition of the patient (subject). It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In certain aspects, it may be desired to administer activated immune effector cells (e.g., T cells, NK cells) to a subject and then subsequently redraw blood (or have an apheresis performed), activate immune effector cells (e.g., T cells, NK cells) therefrom according to the present invention, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

The administration of the subject compositions may be carried out in any convenient manner, including by aerosol inhalation, injection, ingestion, transfusion, implantation or transplantation. The compositions described herein may be administered to a patient transarterially, subcutaneously, intradermally, intratumorally, intranodally, intramedullary, intramuscularly, by intravenous (i.v.) injection, or intraperitoneally. In one aspect, the cell compositions of the present disclosure are administered to a patient by intradermal or subcutaneous injection. In one aspect, the cell compositions of the present disclosure are administered by i.v. injection. The compositions of immune effector cells (e.g., T cells, NK cells) may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T cells. These T cell isolates may be expanded by methods known in the art and treated such that one or more CAR constructs of the invention may be introduced, thereby creating a CAR T cell of the invention. Subjects in need thereof may subsequently undergo standard treatment with high dose chemotherapy followed by peripheral blood stem cell transplantation. In certain aspects, following or concurrent with the transplant, subjects receive an infusion of the expanded CAR T cells of the present invention. In an additional aspect, expanded cells are administered before or following surgery.

The dosage of the above treatments to be administered to a patient will vary with the precise nature of the condition being treated and the recipient of the treatment. The scaling of dosages for human administration can be performed according to art-accepted practices.

Methods of Selectively Regulating the Expression of the Fusion Polypeptide

Provided herein are also methods of selectively regulating (e.g., degrading) a fusion polypeptide (e.g., a fusion polypeptide comprising a COF1/CRBN-, COF2/CRBN-, or COF3/CRBN-binding polypeptide and a heterologous polypeptide, e.g., a CAR polypeptide). Such methods can include contacting a cell comprising any of the fusion polypeptides described herein or a nucleic acid encoding such a fusion polypeptide with COF1, COF2, or COF3. In some embodiments, the COF1/CRBN-, COF2/CRBN-, or COF3/CRBN-binding polypeptide increases a post-translational modification and/or degradation of the fusion polypeptide in the presence of COF1, COF2, or COF3, e.g., relative to the modification and/or degradation in the absence of COF1, COF2, or COF3. In one embodiment, the COF1/CRBN-, COF2/CRBN-, or COF3/CRBN-binding polypeptide increases selective ubiquitination of the fusion polypeptide in the presence of COF1, COF2, or COF3, e.g., relative to the ubiquitination in the absence of COF1, COF2, or COF3. In some embodiments, the cell is contacted with COF1, COF2, or COF3, in vivo. In some embodiments, the cell is contacted with COF1, COF2, or COF3, ex vivo.

As used herein, "selectively degrading" a fusion polypeptide or target polypeptide, or the like, refers to an increase in degradation (e.g. an increased level and/or rate of degradation, e.g., at least 5%, 10%, 15%, 20%, 25%, 30%, 35%, 40%, 45%, 50%, 55%, 60%, 65%, 70%, 75%, 80%, 85%, 90%, 95%, 100%, 200%, 500%, 10 times, 100 times, 1,000 times, or higher) of the fusion polypeptide or target polypeptide, relative to a reference polypeptide, e.g., a polypeptide without the COF1/CRBN-, COF2/CRBN-, or COF3/CRBN-binding polypeptide.

Also provided herein are methods of selectively regulating (e.g., degrading) a fusion polypeptide comprising a COF1/CRBN-, COF2/CRBN-, or COF3/CRBN-binding polypeptide, a heterologous polypeptide, and a degradation domain Such methods comprise one or more of the following steps:

i) contacting the fusion polypeptide or a cell comprising the fusion polypeptide with a stabilization compound, optionally wherein in the presence of the stabilization compound, the expression level of the fusion polypeptide is increased by at least, e.g., 1.5-, 2-, 3-, 4-, 5-, 10-, 20-, 30-, 40-, or 50-fold, compared to the expression level of the fusion polypeptide in the absence of the stabilization compound, e.g., as measured by an assay described herein, e.g., a Western blot analysis or a flow cytometry analysis, and ii) contacting the fusion polypeptide or a cell comprising the fusion polypeptide with COF1, COF2 or COF3, optionally wherein in the presence of COF1, COF2, or COF3, the expression level of the fusion polypeptide is substantially decreased, e.g., by at least about 1, 2, 3, 4, 5, 6, 7, 8, 9, 10, 20, 30, 40, 50, 60, 70, 80, 90, or 100 percent, relative to the expression level of the fusion polypeptide after step i) and before step ii), e.g., as measured by an assay described herein, e.g., a Western blot analysis or a flow cytometry analysis.

In another aspect, the present disclosure provides methods comprising administering a fusion polypeptide of the invention as a therapy. Typically, such administration will be in the form of cells (e.g., autologous or allogeneic host cells) expressing the fusion polypeptide of invention to the subject. Accordingly, through administration of COF1, COF2, or COF3 (either in vivo or ex vivo), the expression of the therapeutic (e.g., the heterologous protein) can be regulated. Accordingly, through administration of COF1, COF2, or COF3 (either in vivo or ex vivo), the expression of the therapeutic (e.g., the heterologous protein) can be regulated. Thus, expression of known synthetic therapeutic proteins or transmembrane receptors (e.g., a fusion polypeptide, e.g., as described herein, e.g., comprising a domain that includes a CAR molecule described herein) can be regulated. In one embodiment, the subject has a disorder described herein, e.g., the subject has cancer, e.g., the subject has a cancer which expresses a target antigen described herein. In one embodiment, the subject is a human.

Provided herein are methods of treating a subject having a disease associated with expression of a tumor antigen by administering to the subject an effective amount of a cell, e.g., a host cell, comprising any of the fusion polypeptides described herein or a nucleic acid encoding such a fusion polypeptide. In some embodiments, the fusion polypeptide comprises a chimeric antigen receptor (CAR), which comprises, in an N-terminal to C-terminal direction, an antigen binding domain that specifically binds the tumor antigen, a transmembrane domain, and one or more intracellular signaling domains. In some embodiments, the host cell is autologous to the subject. In some embodiments, the host cell is allogenic to said subject. In some embodiments, the host cell is contacted with COF1, COF2, or COF3.

In yet another aspect, the invention features a method of treating a subject having a disease associated with expression of a tumor antigen (e.g., an antigen described herein), comprising administering to the subject an effective amount of a cell, e.g., an immune effector cell (e.g., a population of immune effector cells) comprising a fusion polypeptide comprising a CAR molecule, wherein the CAR molecule comprises an antigen binding domain, a transmembrane domain, and an intracellular domain, said intracellular domain comprises a costimulatory domain and/or a primary signaling domain, wherein said antigen binding domain binds to the tumor antigen associated with the disease, e.g. a tumor antigen as described herein.

In a related aspect, the invention features a method of treating a subject having a disease associated with expression of a tumor antigen. The method comprises administering to the subject an effective amount of a cell, e.g., an immune effector cell (e.g., a population of immune effector cells), comprising a fusion polypeptide comprising a CAR molecule, in combination with an agent that increases the efficacy of the immune cell, wherein:

the agent that increases the efficacy of the immune cell is chosen from one or more of:
(i) a protein phosphatase inhibitor;
(ii) a kinase inhibitor;
(iii) a cytokine;
(iv) an inhibitor of an immune inhibitory molecule; or
(v) an agent that decreases the level or activity of a $T_{REG}$ cell.

In another aspect, the invention features a composition comprising an immune effector cell (e.g., a population of immune effector cells) comprising a fusion polypeptide comprising a CAR molecule (e.g., a fusion polypeptide comprising a CAR molecule as described herein) for use in the treatment of a subject having a disease associated with expression of a tumor antigen, e.g., a disorder as described herein.

In certain embodiments of any of the aforesaid methods or uses, the disease associated with a tumor antigen, e.g., a tumor antigen described herein, is selected from a proliferative disease such as a cancer or malignancy or a precancerous condition such as a myelodysplasia, a myelodysplastic syndrome or a preleukemia, or is a non-cancer related indication associated with expression of a tumor antigen described herein. In one embodiment, the disease is a cancer described herein, e.g., a cancer described herein as being associated with a target described herein. In one embodiment, the disease is a hematologic cancer.

In one embodiment, the hematologic cancer is leukemia. In one embodiment, the cancer is selected from the group consisting of one or more acute leukemias including but not limited to B-cell acute lymphoid leukemia ("BALL"), T-cell acute lymphoid leukemia ("TALL"), acute lymphoid leukemia (ALL); one or more chronic leukemias including but not limited to chronic myelogenous leukemia (CML), chronic lymphocytic leukemia (CLL); additional hematologic cancers or hematologic conditions including, but not limited to B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and to disease associated with expression of a tumor antigen described herein include, but not limited to, atypical and/or non-classical cancers, malignancies, precancerous conditions or proliferative diseases expressing a tumor antigen as described herein; and any combination thereof. In another embodiment, the disease associated with a tumor antigen described herein is a solid tumor.

In certain embodiments, the methods or uses are carried out in combination with an agent that increases the efficacy of the immune effector cell, e.g., an agent as described herein. In any of the aforesaid methods or uses, the disease associated with expression of the tumor antigen is selected from the group consisting of a proliferative disease, a precancerous condition, a cancer, and a non-cancer related indication associated with expression of the tumor antigen.

The cancer can be a hematologic cancer, e.g., a cancer chosen from one or more of chronic lymphocytic leukemia (CLL), acute leukemias, acute lymphoid leukemia (ALL), B-cell acute lymphoid leukemia (B-ALL), T-cell acute lymphoid leukemia (T-ALL), chronic myelogenous leukemia (CML), B cell prolymphocytic leukemia, blastic plasmacytoid dendritic cell neoplasm, Burkitt's lymphoma, diffuse large B cell lymphoma, follicular lymphoma, hairy cell leukemia, small cell- or a large cell-follicular lymphoma, malignant lymphoproliferative conditions, MALT lymphoma, mantle cell lymphoma, marginal zone lymphoma, multiple myeloma, myelodysplasia and myelodysplastic syndrome, non-Hodgkin's lymphoma, Hodgkin's lymphoma, plasmablastic lymphoma, plasmacytoid dendritic cell neoplasm, Waldenstrom macroglobulinemia, or preleukemia.

The cancer can also be chosen from colon cancer, rectal cancer, renal-cell carcinoma, liver cancer, non-small cell carcinoma of the lung, cancer of the small intestine, cancer of the esophagus, melanoma, bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin's Disease, non-Hodgkin's lymphoma, cancer of the endocrine system, cancer of the thyroid gland, cancer of the parathyroid gland, cancer of the adrenal gland, sarcoma of soft tissue, cancer of the urethra, cancer of the penis, solid tumors of childhood, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers, combinations of said cancers, and metastatic lesions of said cancers.

In certain embodiments of the methods or uses described herein, the cell is administered in combination with an agent that increases the efficacy of the cell, e.g., one or more of a protein phosphatase inhibitor, a kinase inhibitor, a cytokine, an inhibitor of an immune inhibitory molecule; or an agent that decreases the level or activity of a $T_{REG}$ cell.

In certain embodiments of the methods or uses described herein, the protein phosphatase inhibitor is a SHP-1 inhibitor and/or an SHP-2 inhibitor.

In other embodiments of the methods or uses described herein, kinase inhibitor is chosen from one or more of a CDK4 inhibitor, a CDK4/6 inhibitor (e.g., palbociclib), a BTK inhibitor (e.g., ibrutinib or RN-486), an mTOR inhibitor (e.g., rapamycin or everolimus (RAD001)), an MNK inhibitor, or a dual P13K/mTOR inhibitor. In one embodiment, the BTK inhibitor does not reduce or inhibit the kinase activity of interleukin-2-inducible kinase (ITK).

In other embodiments of the methods or uses described herein, the agent that inhibits the immune inhibitory molecule comprises an antibody or antibody fragment, an inhibitory nucleic acid, a clustered regularly interspaced short palindromic repeats (CRISPR), a transcription-activator like effector nuclease (TALEN), or a zinc finger endonuclease (ZFN) that inhibits the expression of the inhibitory molecule.

In other embodiments of the methods or uses described herein, the agent that decreases the level or activity of the TREG cells is chosen from cyclophosphamide, anti-GITR antibody, CD25-depletion, or a combination thereof.

In certain embodiments of the methods or uses described herein, the immune inhibitory molecule is selected from the group consisting of PD1, PD-L1, CTLA-4, TIM-3, LAG-3, VISTA, BTLA, TIGIT, LAIR1, CD160, 2B4, TGFR beta, CEACAM-1, CEACAM-3, and CEACAM-5.

In other embodiments, the agent that inhibits the inhibitory molecule comprises a first polypeptide comprising an inhibitory molecule or a fragment thereof and a second polypeptide that provides a positive signal to the cell, and wherein the first and second polypeptides are expressed on the CAR-containing immune cells, wherein (i) the first polypeptide comprises PD1, PD-L1, CTLA-4, TIM-3, LAG3, VISTA, BTLA, TIGIT, LAIR1, CD160, 2B4, TGFR beta, CEACAM-1, CEACAM-3, and CEACAM-5 or a fragment thereof; and/or (ii) the second polypeptide comprises an intracellular signaling domain comprising a primary signaling domain and/or a costimulatory signaling domain. In one embodiment, the primary signaling domain comprises a functional domain of CD3 zeta; and/or the costimulatory signaling domain comprises a functional domain of a protein selected from 41BB, CD27 and CD28.

In other embodiments, the cytokine is chosen from IL-7, IL-15, IL-18, or IL-21, or a combination thereof.

In other embodiments, the immune effector cell comprising the fusion polypeptide and a second, e.g., any of the combination therapies disclosed herein (e.g., the agent that that increases the efficacy of the immune effector cell) are administered substantially simultaneously or sequentially.

In other embodiments, the immune cell comprising the fusion polypeptide is administered in combination with a molecule that targets GITR and/or modulates GITR function. In certain embodiments, the molecule targeting GITR and/or modulating GITR function is administered prior to the CAR-expressing cell or population of cells, or prior to apheresis.

In one embodiment, lymphocyte infusion, for example allogeneic lymphocyte infusion, is used in the treatment of the cancer, wherein the lymphocyte infusion comprises at least one CAR-expressing cell of the present invention. In one embodiment, autologous lymphocyte infusion is used in the treatment of the cancer, wherein the autologous lymphocyte infusion comprises at least one CAR-expressing cell described herein.

In one embodiment, the cell is a T cell and the T cell is diaglycerol kinase (DGK) deficient. In one embodiment, the cell is a T cell and the T cell is Ikaros deficient. In one embodiment, the cell is a T cell and the T cell is both DGK and Ikaros deficient.

In one embodiment, the method includes administering a cell expressing the fusion polypeptide comprising a CAR molecule, as described herein, in combination with an agent which enhances the activity of a CAR-expressing cell, wherein the agent is a cytokine, e.g., IL-7, IL-15, IL-18, IL-21, or a combination thereof. The cytokine can be delivered in combination with, e.g., simultaneously or shortly after, administration of the CAR-expressing cell. Alternatively, the cytokine can be delivered after a prolonged period of time after administration of the CAR-expressing cell, e.g., after assessment of the subject's response to the CAR-expressing cell. In one embodiment the cytokine is administered to the subject simultaneously (e.g., administered on the same day) with or shortly after administration (e.g., administered 1 day, 2 days, 3 days, 4 days, 5 days, 6 days, or 7 days after administration) of the cell or population of cells described herein. In other embodiments, the cytokine is administered to the subject after a prolonged period of time (e.g., e.g., at least 2 weeks, 3 weeks, 4 weeks, 6 weeks, 8 weeks, 10 weeks, or more) after administration of the cell or population of cells described herein, or after assessment of the subject's response to the cell.

In other embodiments, the cells expressing a fusion polypeptide comprising a CAR molecule are administered in combination with an agent that ameliorates one or more side effects associated with administration of a cell expressing a CAR molecule. Side effects associated with the CAR-expressing cell can be chosen from cytokine release syndrome (CRS) or hemophagocytic lymphohistiocytosis (HLH).

In embodiments of any of the aforesaid methods or uses, the cells expressing the CAR molecule are administered in combination with an agent that treats the disease associated with expression of the tumor antigen, e.g., any of the second or third therapies disclosed herein.

Additional exemplary combinations include one or more of the following.

In another embodiment, the cell expressing the CAR molecule, e.g., as described herein, can be administered in combination with another agent, e.g., a kinase inhibitor and/or checkpoint inhibitor described herein. In an embodiment, a cell expressing the CAR molecule can further express another agent, e.g., an agent which enhances the activity of a CAR-expressing cell.

For example, in one embodiment, the agent that enhances the activity of a CAR-expressing cell can be an agent which inhibits an inhibitory molecule (e.g., an immune inhibitor molecule). Examples of inhibitory molecules include PD1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGFR beta.

In one embodiment, the agent that inhibits the inhibitory molecule is an inhibitory nucleic acid is a dsRNA, a siRNA, or a shRNA. In embodiments, the inhibitory nucleic acid is linked to the nucleic acid that encodes a component of the CAR molecule. For example, the inhibitory molecule can be expressed on the CAR-expressing cell.

In another embodiment, the agent which inhibits an inhibitory molecule is a molecule described herein, e.g., an agent that comprises a first polypeptide, e.g., an inhibitory molecule, associated with a second polypeptide that provides a positive signal to the cell, e.g., an intracellular signaling domain described herein. In one embodiment, the agent comprises a first polypeptide, e.g., of an inhibitory molecule such as PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 or TGFR beta, or a fragment of any of these (e.g., at least a portion of the extracellular domain of any of these), and a second polypeptide which is an intracellular signaling domain described herein (e.g., comprising a costimulatory domain (e.g., 41BB, CD27 or CD28, e.g., as described herein) and/or a primary signaling domain (e.g., a CD3 zeta signaling domain described herein). In one embodiment, the agent comprises a first polypeptide of PD1 or a fragment thereof (e.g., at least a portion of the extracellular domain of PD1), and a second polypeptide of an intracellular signaling domain described herein (e.g., a CD28 signaling domain described herein and/or a CD3 zeta signaling domain described herein).

In one embodiment, the cell of the present invention, e.g., T cell or NK cell, is administered to a subject that has received a previous stem cell transplantation, e.g., autologous stem cell transplantation.

In one embodiment, the cell of the present invention, e.g., T cell or NK cells, is administered to a subject that has received a previous dose of melphalan.

In one embodiment, the cell expressing a fusion polypeptide comprising a CAR molecule, e.g., a CAR molecule described herein, is administered in combination with an agent that increases the efficacy of a cell expressing a CAR molecule, e.g., an agent described herein.

In one embodiment, the cells expressing a fusion polypeptide comprising a CAR molecule, e.g., a CAR molecule described herein, are administered in combination with a low, immune enhancing dose of an mTOR inhibitor. While not wishing to be bound by theory, it is believed that treatment with a low, immune enhancing, dose (e.g., a dose that is insufficient to completely suppress the immune system but sufficient to improve immune function) is accompanied by a decrease in PD-1 positive T cells or an increase in PD-1 negative cells. PD-1 positive T cells, but not PD-1 negative T cells, can be exhausted by engagement with cells which express a PD-1 ligand, e.g., PD-L1 or PD-L2.

In an embodiment this approach can be used to optimize the performance of CAR cells described herein in the subject. While not wishing to be bound by theory, it is believed that, in an embodiment, the performance of endogenous, non-modified immune effector cells, e.g., T cells or NK cells, is improved. While not wishing to be bound by theory, it is believed that, in an embodiment, the performance of a target antigen CAR-expressing cell is improved. In other embodiments, cells, e.g., T cells or NK cells, which have, or will be engineered to express a CAR, can be treated ex vivo by contact with an amount of an mTOR inhibitor that increases the number of PD1 negative immune effector cells, e.g., T cells or increases the ratio of PD1 negative immune effector cells, e.g., T cells/PD1 positive immune effector cells, e.g., T cells.

In an embodiment, administration of a low, immune enhancing, dose of an mTOR inhibitor, e.g., an allosteric inhibitor, e.g., RAD001, or a catalytic inhibitor, is initiated prior to administration of an CAR expressing cell described herein, e.g., T cells or NK cells. In an embodiment, the CAR cells are administered after a sufficient time, or sufficient dosing, of an mTOR inhibitor, such that the level of PD1 negative immune effector cells, e.g., T cells or NK cells, or the ratio of PD1 negative immune effector cells, e.g., T cells/PD1 positive immune effector cells, e.g., T cells, has been, at least transiently, increased.

In an embodiment, the cell, e.g., T cell or NK cell, to be engineered to express a CAR, is harvested after a sufficient time, or after sufficient dosing of the low, immune enhancing, dose of an mTOR inhibitor, such that the level of PD1 negative immune effector cells, e.g., T cells, or the ratio of PD1 negative immune effector cells, e.g., T cells/PD1 positive immune effector cells, e.g., T cells, in the subject or harvested from the subject has been, at least transiently, increased.

In one embodiment, the cell expressing a fusion polypeptide comprising a CAR molecule, e.g., a CAR molecule described herein, is administered in combination with an agent that ameliorates one or more side effect associated with administration of a cell expressing a CAR molecule, e.g., an agent described herein.

In one embodiment, the cell expressing a fusion polypeptide comprising a CAR molecule, e.g., a CAR molecule described herein, is administered in combination with an agent that treats the disease associated with a cancer associated antigen as described herein, e.g., an agent described herein.

In one embodiment, a cell expressing two or more fusion polypeptides comprising CAR molecules, e.g., as described herein, is administered to a subject in need thereof to treat cancer. In one embodiment, a population of cells including a fusion polypeptide comprising a CAR expressing cell, e.g., as described herein, is administered to a subject in need thereof to treat cancer.

In one embodiment, the cell expressing a fusion polypeptide comprising a CAR molecule, e.g., a CAR molecule described herein, is administered at a dose and/or dosing schedule described herein.

In one embodiment, the fusion polypeptide comprising a CAR molecule is introduced into immune effector cells (e.g., T cells, NK cells), e.g., using in vitro transcription, and the subject (e.g., human) receives an initial administration of cells comprising a fusion polypeptide comprising a CAR molecule, and one or more subsequent administrations of cells comprising a fusion polypeptide comprising a CAR molecule, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of cells comprising a fusion polypeptide comprising a CAR molecule are administered to the subject (e.g., human) per week, e.g., 2, 3, or 4 administrations of cells comprising a fusion polypeptide comprising a CAR molecule are administered per week. In one embodiment, the subject (e.g., human subject) receives more than one administration of cells comprising a fusion polypeptide comprising a CAR molecule per week (e.g., 2, 3 or 4 administrations per week) (also referred to herein as a cycle), followed by a week of no administration of cells comprising a fusion polypeptide comprising a CAR molecule, and then one or more additional administration of cells comprising a CAR molecule (e.g., more than one administration of the cells comprising a CAR molecule per week) is administered to the subject. In another embodiment, the subject (e.g., human subject) receives more than one cycle of cells comprising a fusion polypeptide comprising a CAR molecule, and the time between each cycle is less than 10, 9, 8, 7, 6, 5, 4, or 3 days. In one embodiment, the cells comprising a fusion polypeptide comprising a CAR molecule are administered every other day for 3 administrations per week. In one embodiment, the cells comprising a fusion polypeptide comprising a CAR molecule are administered for at least two, three, four, five, six, seven, eight or more weeks.

In one embodiment, the cells expressing a fusion polypeptide comprising a CAR molecule, e.g., a CAR molecule described herein, are administered as a first line treatment for the disease, e.g., the cancer, e.g., the cancer described herein. In another embodiment, the cells expressing a fusion polypeptide comprising a CAR molecule, e.g., a CAR molecule described herein, are administered as a second, third, fourth line treatment for the disease, e.g., the cancer, e.g., the cancer described herein.

In one embodiment, a population of cells described herein is administered.

In another aspect, the invention pertains to a cell expressing a fusion polypeptide comprising a CAR molecule described herein for use as a medicament in combination with a kinase inhibitor and/or a checkpoint inhibitor as described herein. In another aspect, the invention pertains to a kinase inhibitor and/or a checkpoint inhibitor described herein for use as a medicament in combination with a cell expressing a CAR molecule described herein.

In another aspect, the invention pertains to a cell expressing a fusion polypeptide comprising a CAR molecule described herein for use in combination with a cytokine, e.g., IL-7, IL-15 and/or IL-21 as described herein, in the treatment of a disease expressing a tumor antigen targeted by the CAR. In another aspect, the invention pertains to a cytokine described herein for use in combination with a cell expressing a fusion polypeptide comprising a CAR molecule described herein, in the treatment of a disease expressing a tumor antigen targeted by the CAR.

In another aspect, the invention pertains to a cell expressing a fusion polypeptide comprising a CAR molecule described herein for use in combination with a kinase inhibitor and/or a checkpoint inhibitor as described herein, in the treatment of a disease expressing a tumor antigen targeted by the CAR. In another aspect, the invention pertains to a kinase inhibitor and/or a checkpoint inhibitor described herein for use in combination with a cell expressing a fusion polypeptide comprising a CAR molecule described herein, in the treatment of a disease expressing a tumor antigen targeted by the CAR.

In another aspect, the present disclosure provides a method comprising administering a fusion polypeptide comprising a CAR molecule, e.g., a CAR molecule described herein, or a cell comprising a nucleic acid encoding a fusion polypeptide comprising a CAR molecule, e.g., a CAR molecule described herein. In one embodiment, the subject has a disorder described herein, e.g., the subject has cancer, e.g., the subject has a cancer and has tumor-supporting cells which express a tumor-supporting antigen described herein. In one embodiment, the subject is a human.

In one embodiment of the methods or uses described herein, the fusion polypeptide comprising CAR molecule is administered in combination with another agent. In one embodiment, the agent can be a kinase inhibitor, e.g., a CDK4/6 inhibitor, a BTK inhibitor, an mTOR inhibitor, a MNK inhibitor, or a dual PI3K/mTOR inhibitor, and combinations thereof. In one embodiment, the kinase inhibitor is a CDK4 inhibitor, e.g., a CDK4 inhibitor described herein, e.g., a CD4/6 inhibitor, such as, e.g., 6-Acetyl-8-cyclopentyl-5-methyl-2-(5-piperazin-1-yl-pyridin-2-ylamino)-8H-pyrido[2,3-d]pyrimidin-7-one, hydrochloride (also referred to as palbociclib or PD0332991). In one embodiment, the kinase inhibitor is a BTK inhibitor, e.g., a BTK inhibitor described herein, such as, e.g., ibrutinib. In one embodiment, the kinase inhibitor is an mTOR inhibitor, e.g., an mTOR inhibitor described herein, such as, e.g., rapamycin, a rapamycin analog, OSI-027. The mTOR inhibitor can be, e.g., an mTORC1 inhibitor and/or an mTORC2 inhibitor, e.g., an mTORC1 inhibitor and/or mTORC2 inhibitor described herein. In one embodiment, the kinase inhibitor is a MNK inhibitor, e.g., a MNK inhibitor described herein, such as, e.g., 4-amino-5-(4-fluoroanilino)-pyrazolo [3,4-d] pyrimidine. The MNK inhibitor can be, e.g., a MNK1a, MNK1b, MNK2a and/or MNK2b inhibitor. The dual PI3K/mTOR inhibitor can be, e.g., PF-04695102.

In one embodiment of the methods or uses described herein, the kinase inhibitor is a CDK4 inhibitor selected from aloisine A; flavopiridol or HMR-1275, 2-(2-chlorophenyl)-5,7-dihydroxy-8-[(3S,4R)-3-hydroxy-1-methyl-4-piperidinyl]-4-chromenone; crizotinib (PF-02341066; 2-(2-Chlorophenyl)-5,7-dihydroxy-8-[(2R,3S)-2-(hydroxymethyl)-1-methyl-3-pyrrolidinyl]-4H-1-benzopyran-4-one, hydrochloride (P276-00); 1-methyl-5-[[2-[5-(trifluoromethyl)-1H-imidazol-2-yl]-4-pyridinyl]oxy]-N-[4-(trifluoromethyl)phenyl]-1H-benzimidazol-2-amine (RAF265); indisulam (E7070); roscovitine (CYC202); palbociclib (PD0332991); dinaciclib (SCH727965); N-[5-[[(5-tert-butyloxazol-2-yl)methyl]thio]thiazol-2-yl]piperidine-4-carboxamide (BMS 387032); 4-[[9-chloro-7-(2,6-difluorophenyl)-5H-pyrimido[5,4-d][2]benzazepin-2-yl]amino]-benzoic acid (MLN8054); 5-[3-(4,6-difluoro-1H-benzimidazol-2-yl)-1H-indazol-5-yl]-N-ethyl-4-methyl-3-pyridinemethanamine (AG-024322); 4-(2,6-dichlorobenzoylamino)-1H-pyrazole-3-carboxylic acid N-(piperidin-4-yl)amide (AT7519); 4-[2-methyl-1-(1-methylethyl)-1H-imidazol-5-yl]-N-[4-(methylsulfonyl)phenyl]-2-pyrimidinamine (AZD5438); and XL281 (BMS908662).

In one embodiment of the methods or uses described herein, the kinase inhibitor is a CDK4 inhibitor, e.g., palbociclib (PD0332991), and the palbociclib is administered at a dose of about 50 mg, 60 mg, 70 mg, 75 mg, 80 mg, 90 mg, 100 mg, 105 mg, 110 mg, 115 mg, 120 mg, 125 mg, 130 mg, 135 mg (e.g., 75 mg, 100 mg or 125 mg) daily for a period of time, e.g., daily for 14-21 days of a 28 day cycle, or daily for 7-12 days of a 21 day cycle. In one embodiment, 1, 2, 3, 4, 5, 6, 7, 8, 9, 10, 11, 12 or more cycles of palbociclib are administered.

In one embodiment of the methods or uses described herein, the kinase inhibitor is a BTK inhibitor selected from ibrutinib (PCI-32765); GDC-0834; RN-486; CGI-560; CGI-1764; HM-71224; CC-292; ONO-4059; CNX-774; and LFM-A13. In one embodiment, the BTK inhibitor does not reduce or inhibit the kinase activity of interleukin-2-inducible kinase (ITK), and is selected from GDC-0834; RN-486; CGI-560; CGI-1764; HM-71224; CC-292; ONO-4059; CNX-774; and LFM-A13.

In one embodiment of the methods or uses described herein, the kinase inhibitor is a BTK inhibitor, e.g., ibrutinib (PCI-32765), and the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for 28 day cycle. In one embodiment, 1, 2, 3, 4, 5, 6, 7, 8, 9, 10, 11, 12 or more cycles of ibrutinib are administered.

In one embodiment of the methods or uses described herein, the kinase inhibitor is a BTK inhibitor that does not inhibit the kinase activity of ITK, e.g., RN-486, and RN-486 is administered at a dose of about 100 mg, 110 mg, 120 mg, 130 mg, 140 mg, 150 mg, 160 mg, 170 mg, 180 mg, 190 mg, 200 mg, 210 mg, 220 mg, 230 mg, 240 mg, 250 mg (e.g., 150 mg, 200 mg or 250 mg) daily for a period of time, e.g., daily a 28 day cycle. In one embodiment, 1, 2, 3, 4, 5, 6, 7, or more cycles of RN-486 are administered.

In one embodiment of the methods or uses described herein, the kinase inhibitor is an mTOR inhibitor selected from temsirolimus; ridaforolimus (1R,2R,4S)-4-[(2R)-2 [(1R,9S,12S,15R,16E,18R,19R,21R, 23S,24E,26E,28Z, 30S,32S,35R)-1,18-dihydroxy-19,30- dimethoxy-15,17,21, 23, 29,35-hexamethyl-2,3,10,14,20-pentaoxo-11,36-dioxa-4-azatricyclo[30.3.1.0$^{4,9}$] hexatriaconta-16,24,26,28-tetraen-12-yl]propyl]-2-methoxycyclohexyl dimethylphosphinate, also known as AP23573 and MK8669; everolimus (RAD001); rapamycin (AY22989); simapimod; (5-{2,4-bis[(3S)-3-methylmorpholin-4-yl]pyrido[2,3-d]pyrimidin-7-yl}-2-methoxyphenyl)methanol (AZD8055); 2-amino-8-[trans-4-(2-hydroxyethoxy)cyclohexyl]-6-(6-methoxy-3-pyridinyl)-4-methyl-pyrido[2,3-d] pyrimidin-7(8H)-one (PF04691502); and N$^2$-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine-(SEQ ID NO: 836), inner salt (SF1126); and XL765.

In one embodiment of the methods or uses described herein, the kinase inhibitor is an mTOR inhibitor, e.g., rapamycin, and the rapamycin is administered at a dose of about 3 mg, 4 mg, 5 mg, 6 mg, 7 mg, 8 mg, 9 mg, 10 mg (e.g., 6 mg) daily for a period of time, e.g., daily for 21 day cycle, or daily for 28 day cycle. In one embodiment, 1, 2, 3, 4, 5, 6, 7, 8, 9, 10, 11, 12 or more cycles of rapamycin are administered. In one embodiment, the kinase inhibitor is an mTOR inhibitor, e.g., everolimus and the everolimus is administered at a dose of about 2 mg, 2.5 mg, 3 mg, 4 mg, 5 mg, 6 mg, 7 mg, 8 mg, 9 mg, 10 mg, 11 mg, 12 mg, 13 mg, 14 mg, 15 mg (e.g., 10 mg) daily for a period of time, e.g., daily for 28 day cycle. In one embodiment, 1, 2, 3, 4, 5, 6, 7, 8, 9, 10, 11, 12 or more cycles of everolimus are administered.

In one embodiment of the methods or uses described herein, the kinase inhibitor is an MNK inhibitor selected from CGP052088; 4-amino-3-(p-fluorophenylamino)-pyrazolo [3,4-d] pyrimidine (CGP57380); cercosporamide; ETC-1780445-2; and 4-amino-5-(4-fluoroanilino)-pyrazolo [3,4-d] pyrimidine.

In one embodiment of the methods or uses described herein, the kinase inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7 (8H)-one (PF-04691502); N-[4-[[4-(Dimethylamino)-1-piperidinyl]carbonyl]phenyl]-N'-[4-(4,6-di-4-morpholinyl-1,3, 5-triazin-2-yl)phenyl]urea (PF-05212384, PKI-587); 2-Methyl-2-{4-[3-methyl-2-oxo-8-(quinolin-3-yl)-2,3-dihydro-1H-imidazo[4,5-c]quinolin-1-yl] phenyl}propanenitrile (BEZ-235); apitolisib (GDC-0980, RG7422); 2,4-Difluoro-N-2-(methyloxy)-5-[4-(4-pyridazinyl)-6-quinolinyl]-3-pyridinyl benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl] phenol (PI-103); 5-(9-isopropyl-8-methyl-2-morpholino-9H-purin-6-yl)pyrimidin-2-amine (VS-5584, SB2343); and N-[2-[(3,5-Dimethoxyphenyl)amino]quinoxalin-3-yl]-4-[(4-methyl-3-methoxyphenyl)carbonyl]aminophenylsulfonamide (XL765).

In one embodiment of the methods or uses described herein, a cell comprising a fusion polypeptide described herein is administered to a subject in combination with a protein tyrosine phosphatase inhibitor, e.g., a protein tyrosine phosphatase inhibitor described herein. In one embodiment, the protein tyrosine phosphatase inhibitor is an SHP-1 inhibitor, e.g., an SHP-1 inhibitor described herein, such as, e.g., sodium stibogluconate. In one embodiment, the protein tyrosine phosphatase inhibitor is an SHP-2 inhibitor.

In one embodiment of the methods or uses described herein, a cell comprising a fusion polypeptide described herein is administered in combination with another agent, and the agent is a cytokine. The cytokine can be, e.g., IL-7, IL-15, IL-21, or a combination thereof. In another embodiment, a cell comprising a fusion polypeptide described herein is administered in combination with a checkpoint inhibitor, e.g., a checkpoint inhibitor described herein. For example, in one embodiment, the check point inhibitor inhibits an inhibitory molecule selected from PD-1, PD-L1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGFR beta.

In one aspect, the fusion polypeptide described herein can be used to eradicate a normal cell that express a tumor antigen as described herein, thereby applicable for use as a cellular conditioning therapy prior to cell transplantation. In one aspect, the normal cell that expresses a tumor antigen as described herein is a normal stem cell and the cell transplantation is a stem cell transplantation.

Checkpoint Inhibitors

In other embodiments of the methods or uses described herein, a cell comprising a fusion polypeptide described herein is administered in combination with another agent, and the agent is an inhibitor of a checkpoint inhibitor, e.g., a PD-1 inhibitor, PD-L1 inhibitor, a TIM-3 inhibitor, a LAG-3 inhibitor. Exemplary inhibitors are disclosed in more detail herein below.

PD-1 Inhibitors

In certain embodiments, the inhibitor of the checkpoint inhibitor is a PD-1 inhibitor. In some embodiments, the PD-1 inhibitor is chosen from PDR001 (Novartis), Nivolumab (Bristol-Myers Squibb), Pembrolizumab (Merck & Co), Pidilizumab (CureTech), MEDI0680 (Medimmune), REGN2810 (Regeneron), TSR-042 (Tesaro), PF-06801591 (Pfizer), BGB-A317 (Beigene), BGB-108 (Beigene), INCSHR1210 (Incyte), or AMP-224 (Amplimmune).

Exemplary PD-1 Inhibitors

In one embodiment, the PD-1 inhibitor is an anti-PD-1 antibody molecule. In one embodiment, the PD-1 inhibitor is an anti-PD-1 antibody molecule as described in US 2015/0210769, published on Jul. 30, 2015, entitled "Antibody Molecules to PD-1 and Uses Thereof," incorporated by reference in its entirety. The antibody molecules described herein can be made by vectors, host cells, and methods described in US 2015/0210769, incorporated by reference in its entirety.

Other Exemplary PD-1 Inhibitors

In one embodiment, the anti-PD-1 antibody molecule is Nivolumab (Bristol-Myers Squibb), also known as MDX-1106, MDX-1106-04, ONO-4538, BMS-936558, or OPDIVO®. Nivolumab (clone 5C4) and other anti-PD-1 antibodies are disclosed in U.S. Pat. No. 8,008,449 and WO 2006/121168, incorporated by reference in their entireties.

In one embodiment, the anti-PD-1 antibody molecule is Pembrolizumab (Merck & Co), also known as Lambrolizumab, MK-3475, MK03475, SCH-900475, or KEYTRUDA®. Pembrolizumab and other anti-PD-1 antibodies are disclosed in Hamid, O. et al. (2013) *New England Journal of Medicine* 369 (2): 134-44, U.S. Pat. No. 8,354, 509, and WO 2009/114335, incorporated by reference in their entireties.

In one embodiment, the anti-PD-1 antibody molecule is Pidilizumab (CureTech), also known as CT-011. Pidilizumab and other anti-PD-1 antibodies are disclosed in Rosenblatt, J. et al. (2011) *J Immunotherapy* 34(5): 409-18, U.S. Pat. Nos. 7,695,715, 7,332,582, and 8,686,119, incorporated by reference in their entireties.

In one embodiment, the anti-PD-1 antibody molecule is MEDI0680 (Medimmune), also known as AMP-514. MEDI0680 and other anti-PD-1 antibodies are disclosed in U.S. Pat. No. 9,205,148 and WO 2012/145493, incorporated by reference in their entireties. In one embodiment, the anti-PD-1 antibody molecule comprises one or more of the CDR sequences (or collectively all of the CDR sequences), the heavy chain or light chain variable region sequence, or the heavy chain or light chain sequence of MEDI0680.

In one embodiment, the anti-PD-1 antibody molecule is REGN2810 (Regeneron). In one embodiment, the anti-PD-1 antibody molecule comprises one or more of the CDR sequences (or collectively all of the CDR sequences), the heavy chain or light chain variable region sequence, or the heavy chain or light chain sequence of REGN2810.

In one embodiment, the anti-PD-1 antibody molecule is PF-06801591 (Pfizer). In one embodiment, the anti-PD-1 antibody molecule comprises one or more of the CDR sequences (or collectively all of the CDR sequences), the heavy chain or light chain variable region sequence, or the heavy chain or light chain sequence of PF-06801591.

In one embodiment, the anti-PD-1 antibody molecule is BGB-A317 or BGB-108 (Beigene). In one embodiment, the anti-PD-1 antibody molecule comprises one or more of the CDR sequences (or collectively all of the CDR sequences), the heavy chain or light chain variable region sequence, or the heavy chain or light chain sequence of BGB-A317 or BGB-108.

In one embodiment, the anti-PD-1 antibody molecule is INCSHR1210 (Incyte), also known as INCSHR01210 or SHR-1210. In one embodiment, the anti-PD-1 antibody molecule comprises one or more of the CDR sequences (or collectively all of the CDR sequences), the heavy chain or light chain variable region sequence, or the heavy chain or light chain sequence of INCSHR1210.

In one embodiment, the anti-PD-1 antibody molecule is TSR-042 (Tesaro), also known as ANB011. In one embodiment, the anti-PD-1 antibody molecule comprises one or more of the CDR sequences (or collectively all of the CDR sequences), the heavy chain or light chain variable region sequence, or the heavy chain or light chain sequence of TSR-042.

Further known anti-PD-1 antibodies include those described, e.g., in WO 2015/112800, WO 2016/092419, WO 2015/085847, WO 2014/179664, WO 2014/194302, WO 2014/209804, WO 2015/200119, U.S. Pat. Nos. 8,735,553, 7,488,802, 8,927,697, 8,993,731, and 9,102,727, incorporated by reference in their entireties.

In one embodiment, the anti-PD-1 antibody is an antibody that competes for binding with, and/or binds to the same epitope on PD-1 as, one of the anti-PD-1 antibodies described herein.

In one embodiment, the PD-1 inhibitor is a peptide that inhibits the PD-1 signaling pathway, e.g., as described in U.S. Pat. No. 8,907,053, incorporated by reference in its entirety. In one embodiment, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In one embodiment, the PD-1 inhibitor is AMP-224 (B7-DCIg (Amplimmune), e.g., disclosed in WO 2010/027827 and WO 2011/066342, incorporated by reference in their entireties).

PD-L1 Inhibitors

In certain embodiments, the inhibitor of the checkpoint inhibitor is a PD-L1 inhibitor. In some embodiments, the PD-L1 inhibitor is chosen from FAZ053 (Novartis), Atezolizumab (Genentech/Roche), Avelumab (Merck Serono and Pfizer), Durvalumab (MedImmune/AstraZeneca), or BMS-936559 (Bristol-Myers Squibb).

Exemplary PD-L1 Inhibitors

In one embodiment, the PD-L1 inhibitor is an anti-PD-L1 antibody molecule. In one embodiment, the PD-L1 inhibitor is an anti-PD-L1 antibody molecule as disclosed in US 2016/0108123, published on Apr. 21, 2016, entitled "Antibody Molecules to PD-L1 and Uses Thereof," incorporated by reference in its entirety. The antibody molecules described herein can be made by vectors, host cells, and methods described in US 2016/0108123, incorporated by reference in its entirety.

Other Exemplary PD-L1 Inhibitors

In one embodiment, the anti-PD-L1 antibody molecule is Atezolizumab (Genentech/Roche), also known as MPDL3280A, RG7446, RO5541267, YW243.55.570, or TECENTRIQ™. Atezolizumab and other anti-PD-L1 antibodies are disclosed in U.S. Pat. No. 8,217,149, incorporated by reference in its entirety.

In one embodiment, the anti-PD-L1 antibody molecule is Avelumab (Merck Serono and Pfizer), also known as MSB0010718C. Avelumab and other anti-PD-L1 antibodies are disclosed in WO 2013/079174, incorporated by reference in its entirety.

In one embodiment, the anti-PD-L1 antibody molecule is Durvalumab (MedImmune/AstraZeneca), also known as MEDI4736. Durvalumab and other anti-PD-L1 antibodies are disclosed in U.S. Pat. No. 8,779,108, incorporated by reference in its entirety.

In one embodiment, the anti-PD-L1 antibody molecule is BMS-936559 (Bristol-Myers Squibb), also known as MDX-1105 or 12A4. BMS-936559 and other anti-PD-L1 antibodies are disclosed in U.S. Pat. No. 7,943,743 and WO 2015/081158, incorporated by reference in their entireties.

Further known anti-PD-L1 antibodies include those described, e.g., in WO 2015/181342, WO 2014/100079, WO 2016/000619, WO 2014/022758, WO 2014/055897, WO 2015/061668, WO 2013/079174, WO 2012/145493, WO 2015/112805, WO 2015/109124, WO 2015/195163, U.S. Pat. Nos. 8,168,179, 8,552,154, 8,460,927, and 9,175,082, incorporated by reference in their entireties.

In one embodiment, the anti-PD-L1 antibody is an antibody that competes for binding with, and/or binds to the same epitope on PD-L1 as, one of the anti-PD-L1 antibodies described herein.

LAG-3 Inhibitors

In certain embodiments, the inhibitor of the checkpoint inhibitor is a LAG-3 inhibitor. In some embodiments, the LAG-3 inhibitor is chosen from LAG525 (Novartis), BMS-986016 (Bristol-Myers Squibb), or TSR-033 (Tesaro).

Exemplary LAG-3 Inhibitors

In one embodiment, the LAG-3 inhibitor is an anti-LAG-3 antibody molecule. In one embodiment, the LAG-3 inhibitor is an anti-LAG-3 antibody molecule as disclosed in US 2015/0259420, published on Sep. 17, 2015, entitled "Antibody Molecules to LAG-3 and Uses Thereof," incorporated by reference in its entirety. The antibody molecules described herein can be made by vectors, host cells, and methods described in US 2015/0259420, incorporated by reference in its entirety.

Other Exemplary LAG-3 Inhibitors

In one embodiment, the anti-LAG-3 antibody molecule is BMS-986016 (Bristol-Myers Squibb), also known as BMS986016. BMS-986016 and other anti-LAG-3 antibodies are disclosed in WO 2015/116539 and U.S. Pat. No. 9,505,839, incorporated by reference in their entireties.

In one embodiment, the anti-LAG-3 antibody molecule is TSR-033 (Tesaro). In one embodiment, the anti-LAG-3 antibody molecule comprises one or more of the CDR sequences (or collectively all of the CDR sequences), the heavy chain or light chain variable region sequence, or the heavy chain or light chain sequence of TSR-033.

In one embodiment, the anti-LAG-3 antibody molecule is IMP731 or GSK2831781 (GSK and Prima BioMed). IMP731 and other anti-LAG-3 antibodies are disclosed in WO 2008/132601 and U.S. Pat. No. 9,244,059, incorporated by reference in their entireties. In one embodiment, the anti-LAG-3 antibody molecule comprises one or more of the CDR sequences (or collectively all of the CDR sequences), the heavy chain or light chain variable region sequence, or the heavy chain or light chain sequence of IMP731. In one embodiment, the anti-LAG-3 antibody molecule comprises one or more of the CDR sequences (or collectively all of the CDR sequences), the heavy chain or light chain variable region sequence, or the heavy chain or light chain sequence of GSK2831781.

In one embodiment, the anti-LAG-3 antibody molecule is IMP761 (Prima BioMed). In one embodiment, the anti-LAG-3 antibody molecule comprises one or more of the CDR sequences (or collectively all of the CDR sequences), the heavy chain or light chain variable region sequence, or the heavy chain or light chain sequence of IMP761.

Further known anti-LAG-3 antibodies include those described, e.g., in WO 2008/132601, WO 2010/019570, WO 2014/140180, WO 2015/116539, WO 2015/200119, WO 2016/028672, U.S. Pat. Nos. 9,244,059, 9,505,839, incorporated by reference in their entireties.

In one embodiment, the anti-LAG-3 antibody is an antibody that competes for binding with, and/or binds to the same epitope on LAG-3 as, one of the anti-LAG-3 antibodies described herein.

In one embodiment, the anti-LAG-3 inhibitor is a soluble LAG-3 protein, e.g., IMP321 (Prima BioMed), e.g., as disclosed in WO 2009/044273, incorporated by reference in its entirety.

TIM-3 Inhibitors

In certain embodiments, the inhibitor of the checkpoint inhibitor is a TIM-3 inhibitor. In some embodiments, the TIM-3 inhibitor is MGB453 (Novartis) or TSR-022 (Tesaro).

Exemplary TIM-3 Inhibitors

In one embodiment, the TIM-3 inhibitor is an anti-TIM-3 antibody molecule. In one embodiment, the TIM-3 inhibitor is an anti-TIM-3 antibody molecule as disclosed in US 2015/0218274, published on Aug. 6, 2015, entitled "Antibody Molecules to TIM-3 and Uses Thereof," incorporated by reference in its entirety.

The antibody molecules described herein can be made by vectors, host cells, and methods described in US 2015/0218274, incorporated by reference in its entirety.

Other Exemplary TIM-3 Inhibitors

In one embodiment, the anti-TIM-3 antibody molecule is TSR-022 (AnaptysBio/Tesaro). In one embodiment, the anti-TIM-3 antibody molecule comprises one or more of the CDR sequences (or collectively all of the CDR sequences), the heavy chain or light chain variable region sequence, or the heavy chain or light chain sequence of TSR-022. In one embodiment, the anti-TIM-3 antibody molecule comprises one or more of the CDR sequences (or collectively all of the CDR sequences), the heavy chain or light chain variable region sequence, or the heavy chain or light chain sequence of APE5137 or APE5121. APE5137, APE5121, and other anti-TIM-3 antibodies are disclosed in WO 2016/161270, incorporated by reference in its entirety.

In one embodiment, the anti-TIM-3 antibody molecule is the antibody clone F38-2E2. In one embodiment, the anti-TIM-3 antibody molecule comprises one or more of the CDR sequences (or collectively all of the CDR sequences), the heavy chain or light chain variable region sequence, or the heavy chain or light chain sequence of F38-2E2.

Further known anti-TIM-3 antibodies include those described, e.g., in WO 2016/111947, WO 2016/071448, WO 2016/144803, U.S. Pat. Nos. 8,552,156, 8,841,418, and 9,163,087, incorporated by reference in their entireties.

In one embodiment, the anti-TIM-3 antibody is an antibody that competes for binding with, and/or binds to the same epitope on TIM-3 as, one of the anti-TIM-3 antibodies described herein.

GITR Agonists

In certain embodiments, the fusion polypeptide is administered in combination with a GITR agonist. In some embodiments, the GITR agonist is GWN323 (NVS), BMS-986156, MK-4166 or MK-1248 (Merck), TRX518 (Leap Therapeutics), INCAGN1876 (Incyte/Agenus), AMG 228 (Amgen) or INBRX-110 (Inhibrx).

Exemplary GITR Agonists

In one embodiment, the GITR agonist is an anti-GITR antibody molecule. In one embodiment, the GITR agonist is an anti-GITR antibody molecule as described in WO 2016/057846, published on Apr. 14, 2016, entitled "Compositions and Methods of Use for Augmented Immune Response and Cancer Therapy," incorporated by reference in its entirety.

The antibody molecules described herein can be made by vectors, host cells, and methods described in WO 2016/057846, incorporated by reference in its entirety.

Other Exemplary GITR Agonists

In one embodiment, the anti-GITR antibody molecule is BMS-986156 (Bristol-Myers Squibb), also known as BMS 986156 or BMS986156. BMS-986156 and other anti-GITR antibodies are disclosed, e.g., in U.S. Pat. No. 9,228,016 and WO 2016/196792, incorporated by reference in their entireties. In one embodiment, the anti-GITR antibody molecule comprises one or more of the CDR sequences (or collectively all of the CDR sequences), the heavy chain or light chain variable region sequence, or the heavy chain or light chain sequence of BMS-986156.

In one embodiment, the anti-GITR antibody molecule is MK-4166 or MK-1248 (Merck). MK-4166, MK-1248, and other anti-GITR antibodies are disclosed, e.g., in U.S. Pat. No. 8,709,424, WO 2011/028683, WO 2015/026684, and Mahne et al. *Cancer Res.* 2017; 77(5):1108-1118, incorporated by reference in their entireties. In one embodiment, the anti-GITR antibody molecule comprises one or more of the CDR sequences (or collectively all of the CDR sequences), the heavy chain or light chain variable region sequence, or the heavy chain or light chain sequence of MK-4166 or MK-1248.

In one embodiment, the anti-GITR antibody molecule is TRX518 (Leap Therapeutics). TRX518 and other anti-GITR antibodies are disclosed, e.g., in U.S. Pat. Nos. 7,812,135, 8,388,967, 9,028,823, WO 2006/105021, and Ponte J et al. (2010) Clinical Immunology; 135:S96, incorporated by reference in their entireties. In one embodiment, the anti-GITR antibody molecule comprises one or more of the CDR sequences (or collectively all of the CDR sequences), the heavy chain or light chain variable region sequence, or the heavy chain or light chain sequence of TRX518.

In one embodiment, the anti-GITR antibody molecule is INCAGN1876 (Incyte/Agenus). INCAGN1876 and other anti-GITR antibodies are disclosed, e.g., in US 2015/0368349 and WO 2015/184099, incorporated by reference in their entireties. In one embodiment, the anti-GITR antibody molecule comprises one or more of the CDR sequences (or collectively all of the CDR sequences), the heavy chain or light chain variable region sequence, or the heavy chain or light chain sequence of INCAGN1876.

In one embodiment, the anti-GITR antibody molecule is AMG 228 (Amgen). AMG 228 and other anti-GITR antibodies are disclosed, e.g., in U.S. Pat. No. 9,464,139 and WO 2015/031667, incorporated by reference in their entireties. In one embodiment, the anti-GITR antibody molecule comprises one or more of the CDR sequences (or collectively all of the CDR sequences), the heavy chain or light chain variable region sequence, or the heavy chain or light chain sequence of AMG 228.

In one embodiment, the anti-GITR antibody molecule is INBRX-110 (Inhibrx). INBRX-110 and other anti-GITR antibodies are disclosed, e.g., in US 2017/0022284 and WO 2017/015623, incorporated by reference in their entireties. In one embodiment, the GITR agonist comprises one or more of the CDR sequences (or collectively all of the CDR sequences), the heavy chain or light chain variable region sequence, or the heavy chain or light chain sequence of INBRX-110.

In one embodiment, the GITR agonist (e.g., a fusion polypeptide) is MEDI 1873 (MedImmune), also known as MEDI1873. MEDI 1873 and other GITR agonists are disclosed, e.g., in US 2017/0073386, WO 2017/025610, and Ross et al. *Cancer Res* 2016; 76(14 Suppl): Abstract nr 561, incorporated by reference in their entireties. In one embodiment, the GITR agonist comprises one or more of an IgG Fc domain, a functional multimerization domain, and a receptor binding domain of a glucocorticoid-induced TNF receptor ligand (GITRL) of MEDI 1873.

Further known GITR agonists (e.g., anti-GITR antibodies) include those described, e.g., in WO 2016/054638, incorporated by reference in its entirety.

In one embodiment, the anti-GITR antibody is an antibody that competes for binding with, and/or binds to the same epitope on GITR as, one of the anti-GITR antibodies described herein.

In one embodiment, the GITR agonist is a peptide that activates the GITR signaling pathway. In one embodiment, the GITR agonist is an immunoadhesin binding fragment (e.g., an immunoadhesin binding fragment comprising an extracellular or GITR binding portion of GITRL) fused to a constant region (e.g., an Fc region of an immunoglobulin sequence).

IL15/IL-15Ra Complexes

In certain embodiments, the fusion polypeptide is administered in combination with a IL-15/IL-15Ra complex. In some embodiments, the IL-15/IL-15Ra complex is chosen from NIZ985 (Novartis), ATL-803 (Altor) or CYP0150 (Cytune).

Exemplary IL-15/IL-15Ra Complexes

In one embodiment, the IL-15/IL-15Ra complex comprises human IL-15 complexed with a soluble form of human IL-15Ra. The complex may comprise IL-15 covalently or noncovalently bound to a soluble form of IL-15Ra. In a particular embodiment, the human IL-15 is noncovalently bonded to a soluble form of IL-15Ra. In a particular embodiment, the human IL-15 of the composition comprises an amino acid sequence as described in WO 2014/066527, incorporated by reference in its entirety. The molecules described herein can be made by vectors, host cells, and methods described in WO 2007/084342, incorporated by reference in its entirety.

Other Exemplary IL-15/IL-15Ra Complexes

In one embodiment, the IL-15/IL-15Ra complex is ALT-803, an IL-15/IL-15Ra Fc fusion polypeptide (IL-15N72D:IL-15RaSu/Fc soluble complex). ALT-803 is disclosed in WO 2008/143794, incorporated by reference in its entirety.

In one embodiment, the IL-15/IL-15Ra complex comprises IL-15 fused to the sushi domain of IL-15Ra (CYP0150, Cytune). The sushi domain of IL-15Ra refers to a domain beginning at the first cysteine residue after the signal peptide of IL-15Ra, and ending at the fourth cysteine residue after said signal peptide. The complex of IL-15 fused to the sushi domain of IL-15Ra is disclosed in WO 2007/04606 and WO 2012/175222, incorporated by reference in their entireties.

Screening Methods

The present invention includes methods of identifying a genetic element associated with a specific biological phenotype, e.g., a genetic element associated with the development and/or progression of a disorder, e.g., cancer. The method including the steps of: (i) modulating the expression of a fusion polypeptide in a cell, e.g., a host cell, by exposing said cell to COF1, COF2, or COF3, (ii) selecting for the cells with a phenotype of interest, e.g., a phenotype associated with the development and/or progression of a disorder, e.g., cancer, and (iii) identifying the fusion polypeptide that induces the phenotype of interest, wherein exposure of the cell to COF1, COF2, or COF3 decreases, e.g., by at least about 1, 2, 3, 4, 5, 6, 7, 8, 9, 10, 20, 30, 40, 50, 60, 70, 80, 90, or 100 percent, the expression of said fusion polypeptide relative to the level of expression of said fusion polypeptide prior to exposure to COF1, COF2, or COF3.

Methods of Treating a Subject

In some aspects, the disclosure provides a method of treating a patient, comprising administering a fusion polypeptide (e.g., comprising a COF1/CRBN-, COF2/CRBN-, or COF3/CRBN-binding polypeptide and a heterologous polypeptide of interest) or cells expressing the fusion polypeptide (e.g., CAR-expressing cells) manufactured as described herein, optionally in combination with one or more other therapies. In some aspects, the disclosure provides a method of treating a patient, comprising administering a reaction mixture comprising the fusion polypeptide or cells expressing the fusion polypeptide (e.g., CAR-expressing cells) as described herein, optionally in combination with one or more other therapies. In some aspects, the disclosure provides a method of shipping or receiving a reaction mixture comprising the fusion polypeptide or cells expressing the fusion polypeptide (e.g., CAR-expressing cells) as described herein.

In some aspects, the disclosure provides a method of treating a patient, comprising receiving the fusion polypeptide (e.g., comprising a COF1/CRBN-, COF2/CRBN-, or COF3/CRBN-binding polypeptide and a heterologous polypeptide of interest) or cells expressing the fusion polypeptide (e.g., CAR-expressing cells) that was manufactured as described herein, and further comprising administering the fusion polypeptide or cells expressing the fusion polypeptide (e.g., CAR-expressing cells) to the patient, optionally in combination with one or more other therapies. In some aspects, the disclosure provides a method of treating a patient, comprising manufacturing the fusion polypeptide or cells expressing the fusion polypeptide (e.g., CAR-expressing cells) as described herein, and further comprising administering the fusion polypeptide or cells expressing the fusion polypeptide (e.g., CAR-expressing cells) to the patient, optionally in combination with one or more other therapies. The other therapy may be, e.g., a cancer therapy such as chemotherapy.

The methods described herein can further include formulating the fusion polypeptide (e.g., comprising a COF1/CRBN-, COF2/CRBN-, or COF3/CRBN-binding polypeptide and a heterologous polypeptide of interest) or cells expressing the fusion polypeptide (e.g., CAR-expressing cells) in a pharmaceutical composition. Pharmaceutical compositions may comprise a fusion polypeptide or cells expressing the fusion polypeptide (e.g., CAR-expressing cells), e.g., a plurality of fusion polypeptides or cells expressing the fusion polypeptide (e.g., CAR-expressing cells), as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions can be formulated, e.g., for intravenous administration.

In one embodiment, the pharmaceutical composition is substantially free of, e.g., there are no detectable levels of a contaminant, e.g., selected from the group consisting of endotoxin, *mycoplasma*, replication competent lentivirus (RCL), p24, VSV-G nucleic acid, HIV gag, residual anti-CD3/anti-CD28 coated beads, mouse antibodies, pooled human serum, bovine serum albumin, bovine serum, culture media components, vector packaging cell or plasmid components, a bacterium and a fungus. In one embodiment, the bacterium is at least one selected from the group consisting of *Alcaligenes faecalis, Candida albicans, Escherichia coli, Haemophilus influenza, Neisseria meningitides, Pseudomonas aeruginosa, Staphylococcus aureus, Streptococcus pneumonia*, and *Streptococcus pyogenes* group A.

When "an immunologically effective amount," "an anti-cancer effective amount," "a cancer-inhibiting effective amount," or "therapeutic amount" is indicated, the precise amount of the compositions to be administered can be determined by a physician with consideration of individual differences in age, weight, tumor size, extent of infection or metastasis, and condition of the patient (subject). It can generally be stated that a pharmaceutical composition comprising the immune effector cells (e.g., T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In some embodiments, a dose of CAR cells (e.g., CD19 CAR cells) comprises about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises at least about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises up to about $1\times10^6$, $1.1\times10^6$, $2\times10^6$, $3.6\times10^6$, $5\times10^6$, $1\times10^7$, $1.8\times10^7$, $2\times10^7$, $5\times10^7$, $1\times10^8$, $2\times10^8$, or $5\times10^8$ cells/kg. In some embodiments, a dose of CAR cells (e.g., CD19 CAR cells) comprises about $1.1\times10^6$-$1.8\times10^7$ cells/kg. In some embodiments, a dose of CAR cells (e.g., CD19 CAR cells) comprises about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD19 CAR cells) comprises at least about $1\times10^7$, $2\times10^7$, $5\times10^7$, $1\times10^8$, $2\times10^8$, $5\times10^8$, $1\times10^9$, $2\times10^9$, or $5\times10^9$ cells. In some embodiments, a dose of CAR cells (e.g., CD19 CAR cells) comprises up to about $1\times10^7$, $2\times10^7$, $5\times10^7$, $1\times10^8$, $2\times10^8$, $5\times10^8$, $1\times10^9$, $2\times10^9$, or $5\times10^9$ cells. In certain aspects, it may be desired to administer activated immune effector cells (e.g., T cells, NK cells) to a subject and then subsequently redraw blood (or have an apheresis performed), activate immune effector cells (e.g., T cells, NK cells) therefrom, and reinfuse the patient with these activated and expanded immune effector cells (e.g., T cells, NK cells). This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

In embodiments, the CAR-expressing cells (e.g., the CD19 CAR-expressing cells) are administered in a plurality of doses, e.g., a first dose, a second dose, and optionally a third dose. In embodiments, the method comprises treating a subject (e.g., an adult subject) having a cancer (e.g., acute lymphoid leukemia (ALL)), comprising administering to the subject a first dose, a second dose, and optionally one or more additional doses, each dose comprising immune effector cells expressing a CAR molecule, e.g., a CD19 CAR molecule.

In embodiments, the method comprises administering a dose of $2$-$5\times10^6$ viable CAR-expressing cells/kg, wherein the subject has a body mass of less than 50 kg; or administering a dose of $1.0$-$2.5\times10^8$ viable CAR-expressing cells, wherein the subject has a body mass of at least 50 kg.

In embodiments, a single dose is administered to the subject, e.g., pediatric subject.

In embodiments, the doses are administered on sequential days, e.g., the first dose is administered on day 1, the second dose is administered on day 2, and the optional third dose (if administered) is administered on day 3.

In embodiments, a fourth, fifth, or sixth dose, or more doses, are administered.

In embodiments, the first dose comprises about 10% of the total dose, the second dose comprises about 30% of the total dose, and the third dose comprises about 60% of the total dose, wherein the aforementioned percentages have a sum of 100%. In embodiments, the first dose comprises about 9-11%, 8-12%, 7-13%, or 5-15% of the total dose. In embodiments, the second dose comprises about 29-31%, 28-32%, 27-33%, 26-34%, 25-35%, 24-36%, 23-37%, 22-38%, 21-39%, or 20-40% of the total dose. In embodiments, the third dose comprises about 55-65%, 50-70%, 45-75%, or 40-80% of the total dose. In embodiments, the total dose refers to the total number of viable CAR-expressing cells administered over the course of 1 week, 2 weeks, 3 weeks, or 4 weeks. In some embodiments wherein two doses are administered, the total dose refers to the sum of the number of viable CAR-expressing cells administered to the subject in the first and second doses. In some embodiments wherein three doses are administered, the total dose refers to the sum of the number of viable CAR-expressing cells administered to the subject in the first, second, and third doses.

In embodiments, the dose is measured according to the number of viable CAR-expressing cells therein. CAR expression can be measured, e.g., by flow cytometry using an antibody molecule that binds the CAR molecule and a detectable label. Viability can be measured, e.g., by Cellometer.

In embodiments, the viable CAR-expressing cells are administered in ascending doses. In embodiments, the second dose is larger than the first dose, e.g., larger by 10%, 20%, 30%, or 50%. In embodiments, the second dose is twice, three times, four times, or five times the size of the first dose. In embodiments, the third dose is larger than the second dose, e.g., larger by 10%, 20%, 30%, or 50%. In embodiments, the third dose is twice, three times, four times, or five times the size of the second dose.

In certain embodiments, the method includes one, two, three, four, five, six, seven or all of a)-h) of the following:
 a) the number of CAR-expressing, viable cells administered in the first dose is no more than 1/3, of the number of CAR-expressing, viable cells administered in the second dose;
 b) the number of CAR-expressing, viable cells administered in the first dose is no more than 1/X, wherein X is 2, 3, 4, 5, 6, 7, 8, 9, 10, 15, 20, 30, 40 or 50, of the total number of CAR-expressing, viable cells administered;

c) the number of CAR-expressing, viable cells administered in the first dose is no more than $1 \times 10^7$, $2 \times 10^7$, $3 \times 10^7$, $4 \times 10^7$, $5 \times 10^7$, $6 \times 10^7$, $7 \times 10^7$, $8 \times 10^7$, $9 \times 10^7$, $1 \times 10^8$, $2 \times 10^8$, $3 \times 10^8$, $4 \times 10^8$, or $5 \times 10^8$ CAR-expressing, viable cells, and the second dose is greater than the first dose;

d) the number of CAR-expressing, viable cells administered in the second dose is no more than ½, of the number of CAR-expressing, viable cells administered in the third dose;

e) the number of CAR-expressing, viable cells administered in the second dose is no more than 1/Y, wherein Y is 2, 3, 4, 5, 6, 7, 8, 9, 10, 15, 20, 30, 40 or 50, of the total number of CAR-expressing, viable cells administered;

f) the number of CAR-expressing, viable cells administered in the second dose is no more than $1 \times 10^7$, $2 \times 10^7$, $3 \times 10^7$, $4 \times 10^7$, $5 \times 10^7$, $6 \times 10^7$, $7 \times 10^7$, $8 \times 10^7$, $9 \times 10^7$, $1 \times 10^8$, $2 \times 10^8$, $3 \times 10^8$, $4 \times 10^8$, or $5 \times 10^8$ CAR-expressing, viable cells, and the third dose is greater than the second dose;

h) the dosages and time periods of administration of the first, second, and optionally third doses are selected such that the subject experiences CRS at a level no greater than 4, 3, 2, or 1.

In embodiments, the total dose is about $5 \times 10^8$ CAR-expressing, viable cells. In embodiments, the total dose is about $5 \times 10^7$-$5 \times 10^8$ CAR-expressing, viable cells. In embodiments, the first dose is about $5 \times 10^7$ (e.g., ±10%, 20%, or 30%) CAR-expressing, viable cells, the second dose is about $1.5 \times 10^8$ (e.g., ±10%, 20%, or 30%) CAR-expressing, viable cells, and the third dose is about $3 \times 10^8$ (e.g., ±10%, 20%, or 30%) CAR-expressing, viable cells.

In embodiments, the subject is evaluated for CRS after receiving a dose, e.g., after receiving the first dose, the second dose, and/or the third dose.

In embodiments, the subject receives a CRS treatment, e.g., tocilizumab, a corticosteroid, etanercept, or siltuximab. In embodiments, the CRS treatment is administered before or after the first dose of cells comprising the CAR molecule. In embodiments, the CRS treatment is administered before or after the second dose of cells comprising the CAR molecule. In embodiments, the CRS treatment is administered before or after the third dose of cells comprising the CAR molecule. In embodiments, the CRS treatment is administered between the first and second doses of cells comprising the CAR molecule, and/or between the second and third doses of cells comprising the CAR molecule.

The administration of the subject compositions may be carried out in any convenient manner. The compositions described herein may be administered to a patient trans arterially, subcutaneously, intradermally, intratumorally, intranodally, intramedullary, intramuscularly, by intravenous (i.v.) injection, or intraperitoneally, e.g., by intradermal or subcutaneous injection. The compositions of immune effector cells (e.g., T cells, NK cells) may be injected directly into a tumor, lymph node, or site of infection.

In an embodiment, cells expressing a CAR described herein are administered to a subject in combination with a molecule that decreases the $T_{REG}$ cell population. Methods that decrease the number of (e.g., deplete) $T_{REG}$ cells are known in the art and include, e.g., CD25 depletion, cyclophosphamide administration, and modulating GITR function. Without wishing to be bound by theory, it is believed that reducing the number of $T_{REG}$ cells in a subject prior to apheresis or prior to administration of a CAR-expressing cell described herein reduces the number of unwanted immune cells (e.g., Tregs) in the tumor microenvironment and reduces the subject's risk of relapse.

In one embodiment, cells expressing a CAR described herein are administered to a subject in combination with a molecule targeting GITR and/or modulating GITR functions, such as a GITR agonist and/or a GITR antibody that depletes regulatory T cells ($T_{REG}$s). In embodiments, cells expressing a CAR described herein are administered to a subject in combination with cyclophosphamide. In one embodiment, the GITR binding molecules and/or molecules modulating GITR functions (e.g., GITR agonist and/or Treg depleting GITR antibodies) are administered prior to administration of the CAR-expressing cell. For example, in one embodiment, the GITR agonist can be administered prior to apheresis of the cells. In embodiments, cyclophosphamide is administered to the subject prior to administration (e.g., infusion or re-infusion) of the CAR-expressing cell or prior to aphersis of the cells. In embodiments, cyclophosphamide and an anti-GITR antibody are administered to the subject prior to administration (e.g., infusion or re-infusion) of the CAR-expressing cell or prior to apheresis of the cells. In one embodiment, the subject has cancer (e.g., a solid cancer or a hematological cancer such as ALL or CLL). In an embodiment, the subject has CLL. In embodiments, the subject has ALL. In embodiments, the subject has a solid cancer, e.g., a solid cancer described herein. Exemplary GITR agonists include, e.g., GITR fusion polypeptides and anti-GITR antibodies (e.g., bivalent anti-GITR antibodies) such as, e.g., a GITR fusion polypeptide described in U.S. Pat. No. 6,111,090, European Patent No.: 090505B1, U.S. Pat. No. 8,586,023, PCT Publication Nos.: WO 2010/003118 and 2011/090754, or an anti-GITR antibody described, e.g., in U.S. Pat. No. 7,025,962, European Patent No.: 1947183B1, U.S. Pat. Nos. 7,812,135, 8,388,967, 8,591,886, European Patent No.: EP 1866339, PCT Publication No.: WO 2011/028683, PCT Publication No.: WO 2013/039954, PCT Publication No.: WO2005/007190, PCT Publication No.: WO 2007/133822, PCT Publication No.: WO2005/055808, PCT Publication No.: WO 99/40196, PCT Publication No.: WO 2001/03720, PCT Publication No.: WO99/20758, PCT Publication No.: WO2006/083289, PCT Publication No.: WO 2005/115451, U.S. Pat. No. 7,618,632, and PCT Publication No.: WO 2011/051726.

In one embodiment, a CAR expressing cell described herein is administered to a subject in combination with a GITR agonist, e.g., a GITR agonist described herein. In one embodiment, the GITR agonist is administered prior to the CAR-expressing cell. For example, in one embodiment, the GITR agonist can be administered prior to apheresis of the cells. In one embodiment, the subject has CLL.

EXAMPLES

The invention is further described in detail by reference to the following experimental examples. These examples are provided for purposes of illustration only, and are not intended to be limiting unless otherwise specified. Thus, the invention should in no way be construed as being limited to the following examples, but rather, should be construed to encompass any and all variations which become evident as a result of the teaching provided herein.

Example 1: Evaluation of an IKZF3-Based Degradation Tag by Luciferase Assay

In this example, an IKZF3-based degradation tag was tested for its ability to facilitate lenalidomide-dependent degradation of a target protein. The IKZF3-based degradation tag includes amino acid residues 136-180 and 236-249 of human IKZF3 and comprises the amino acid sequence of SEQ ID NO: 3. This tag is herein referred to as "IKZF3 136-180 and 236-249" or the "HilD-tag." IKZF3 136-180 and 236-249 was fused to the N-terminus of NanoLuciferase through a 16GS linker GGGGSGGGGTGGGGSG (SEQ ID NO: 28) (FIG. 1A). A pNL1.1CMV vector encoding the IKZF3 136-180 and 236-249-tagged NanoLuciferase was reverse transfected into HEK293T cells using a total of 0 ng, 5 ng, 50 ng, or 250 ng DNA (DNA values here were based on a 384 well 25 µl transfection that was then scaled up to a 6 well dish).

Transfected cells received a 1-hour pre-treatment with 128 ng/mL cyclohexamide, 12.8 ng/mL cyclohexamide, or 10 µM MG132 prior to treatment with 0 µM, 1 µM, 10 µM, or 100 µM lenalidomide for 2, 4, or 6 hours. DMSO was included as a vehicle control. Luminescence was measured by reading each 384-well plate on a ViewLux® with 1-second and 5-second exposures. The data was imported into Spotfire® and visualizations were made by doing a NC3 normalization according to the following formula: 100* ([Luminescence]/[DMSO]).

Figure 1B:
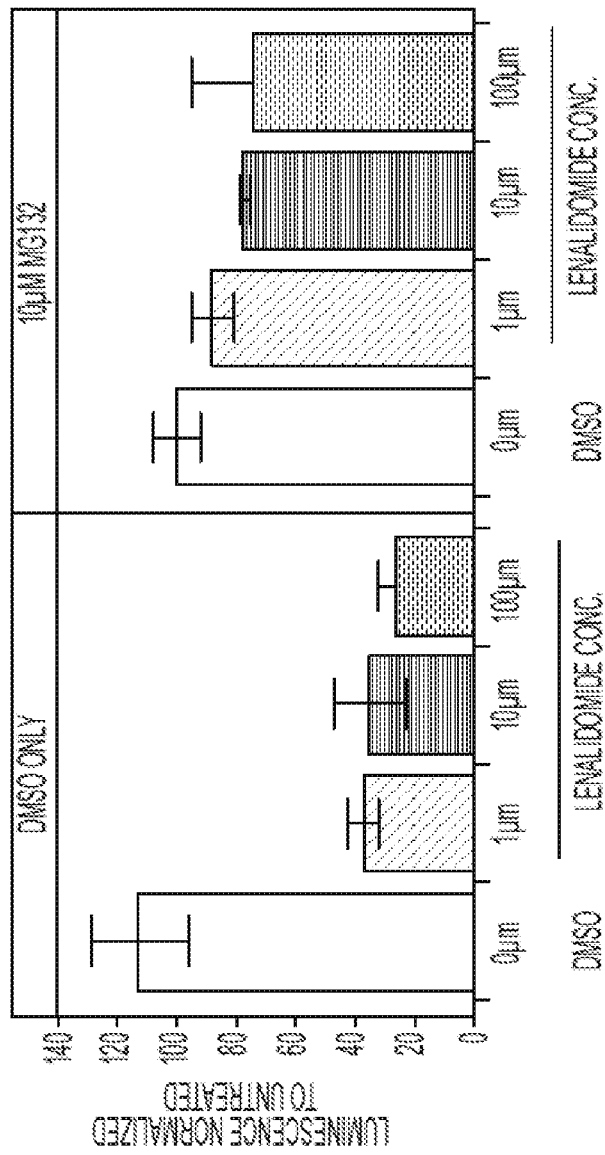
FIG. 1B is a graph showing the level of luminescence measured from HEK293T cells reverse transfected with 50 ng of pNL1.1CMV construct encoding NanoLuciferase linked to IKZF3 136-180 and 236-249. IKZF3 136-180 and 236-249 facilitated a reduction in luminescence in cells treated with 1 µM, 10 µM, or 100 µM lenalidomide for 6 hours as compared to cells treated with DMSO only. MG132 treatment blocked lenalidomide-dependent degradation of NanoLuciferase.

The degradation tag including amino acid residues 136-180 and 236-249 of IKZF3 can facilitate lenalidomide-dependent degradation of a target protein (FIG. 1B). IKZF3 136-180 and 236-249 facilitated lenalidomide-dependent degradation of NanoLuciferase observed at all concentrations of DNA tested. The most degradation (~60%) was observed in cells transfected with 5 ng of DNA (FIG. 1B). Importantly, lenalidomide-dependent degradation was blocked by MG132 treatment, indicating that lenalidomide-dependent degradation of a target protein is proteasome dependent (FIG. 1B). No obvious reduction in lenalidomide-dependent degradation of NanoLuciferase was observed with cyclohexamide treatment (data not shown).

Example 2: Evaluation of an IKZF3-Based Degradation Tag by Western Blot

IKZF3 136-180 and 236-249 facilitated lenalidomide-dependent degradation of NanoLuciferase was evaluated by Western blot. The pNL1.1CMV vector encoding the IKZF3 136-180 and 236-249-tagged NanoLuciferase described above was transfected into 293GT cells and 293GT cereblon (CRBN) knockout (KO) cells. Transfected cells were then treated with 100 µM, 10 µM, 1 µM, 0.1 µM, 0.01 µM, or 0.001 µM lenalidomide, or DMSO for one-hour at 37° C. Pre-treatment samples were treated with 10 µM MG132 for one-hour at 37° C. prior to treatment with 100 µM lenalidomide. Samples were pelleted, lysed, run on a protein gel, transferred to a membrane, probed with antibody and developed with film.

Figure 2:
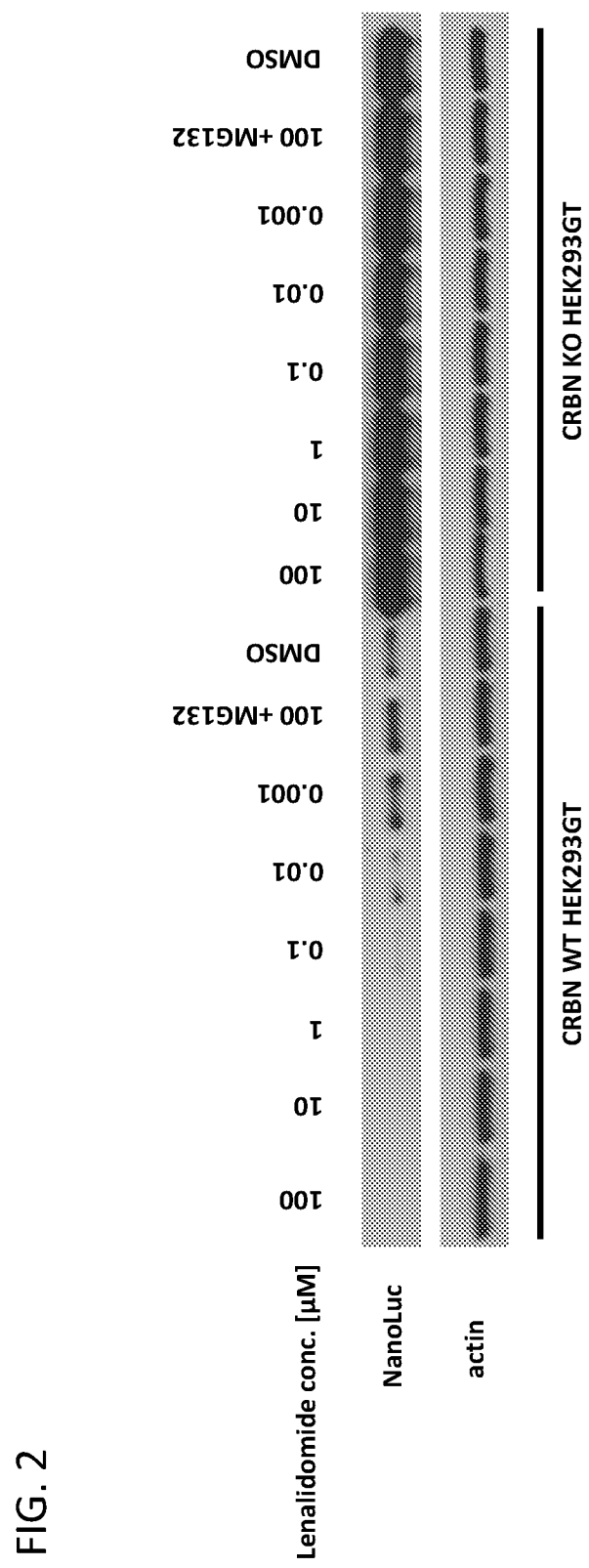
FIG. 2 is a Western blot showing that IKZF3 136-180 and 236-249 facilitated lenalidomide-dependent degradation of NanoLuciferase (IC50=10 nM) in HEK293GT cells transfected with a pNL1.1CMV construct encoding IKZF3 136-180 and 236-249-tagged NanoLuciferase. Lenalidomide-dependent degradation was not observed in HEK293GT Cereblon (CRBN) KO cells that were similarly transfected. Treatment with a proteasome inhibitor, MG132, blocked the ability of IKZF3 136-180 and 236-249 to facilitate lenalidomide-dependent degradation.

The data further show that IKZF3 136-180 and 236-249 could facilitate lenalidomide-dependent degradation of the target protein with increasing lenalidomide concentrations (IC50=~10 nM) (FIG. 2). Lenalidomide-dependent degradation of NanoLuciferase was not observed in transfected 293GT CRBN KO cells or in cells pre-treated with MG132 (FIG. 2). These data indicate that lenalidomide-dependent degradation of a target protein having an IKZF3 136-180 and 236-249 tag is CRBN and proteasome dependent.

Example 3: Design and Evaluation of Variant IKZF3-Based Degradation Tags

To determine whether a shorter IKZF3-based degradation tag could facilitate lenalidomide-dependent degradation of a target protein, the following IKZF3-based degradation tags were designed: "IKZF3 136-180," which included amino acid residues 136-180 of IKZF3 (a tag comprising the amino acid sequence of SEQ ID NO: 5); "IKZF3 145-170," which included amino acid residues 145-170 of IKZF3 (a tag comprising the amino acid sequence of SEQ ID NO: 9); and "IKZF3 140-169," which included amino acid residues 140-169 of IKZF3 (a tag comprising the amino acid sequence of SEQ ID NO: 24).

Additionally, the IKZF3-based degradation tags were modified using the following strategies:
(1) deleting N-terminal and/or C-terminal amino acid residues;
(2) replacing amino acid residues 236-249, which correspond to an alpha-helix of IKZF3, with the amino acid sequence of MALEKMALEKMALE (SEQ ID NO: 91); and/or
(3) mutating the lysine residue at amino acid position 245 in the alpha-helix of IKZF3 to arginine or serine (i.e., by incorporating a K245R or K245S mutation, numbered according to SEQ ID NO: 19).

These variant IKZF3-based degradation tags were fused to the N-terminus of NanoLuciferase and cloned into the pNL1.1CMV vector, which has a CMV promoter. 5 ng (for all the tags that do not include residues 236-249 of SEQ ID NO: 19) or 50 ng (for all the tags that include residues 236-249 of SEQ ID NO: 19) of each construct was transfected into HEK293T cells. The transfected cells were treated with 100 µM, 10 µM, 1 µM, 0.1 µM, 0.01 µM, or 0.001 µM lenalidomide, or DMSO control for 2-4 hours at 37° C. Pre-treatment samples were treated with 10 µM MG132 for one-hour at 37° C. prior to treatment with 100 µM lenalidomide. Protein degradation was measured using western blot as described in Example 2.

Results from two studies are described below.

Figure 3A:
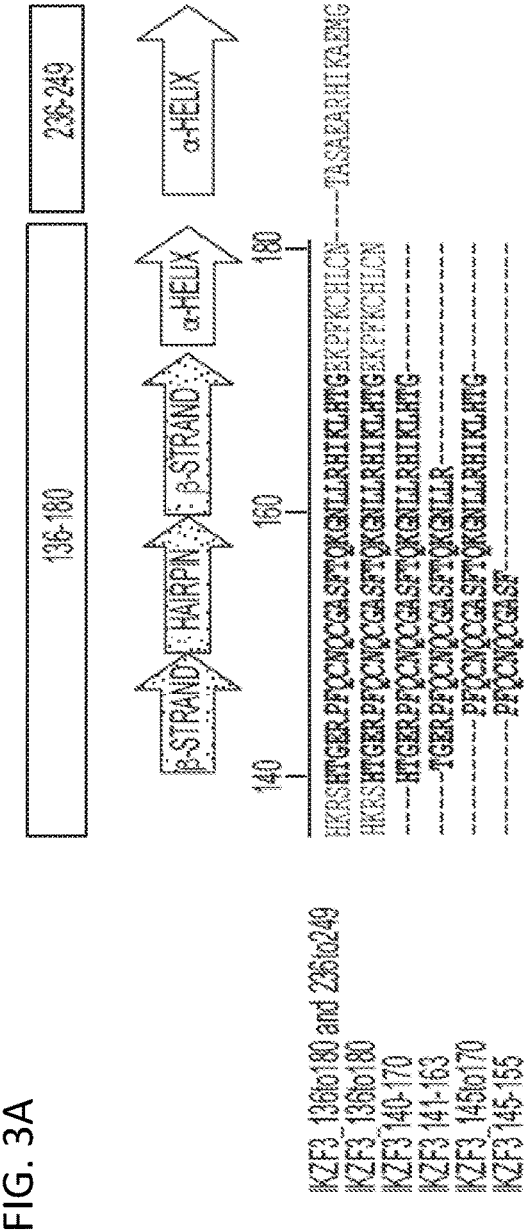
FIG. 3A is a schematic depicting IKZF3 136-180 which contains two beta-sheets flanking a hairpin and an alpha-helix as well as IKZF3 236-249, which is predicted as an additional alpha-helix. Below the schematic is a diagram of the shortened versions of the IKZF3 136-180 degron, eliminating amino acids on the N and C-terminus (SEQ ID NOs: 3, 5, and 7-10, respectively, in order of appearance).
Figure 3B:
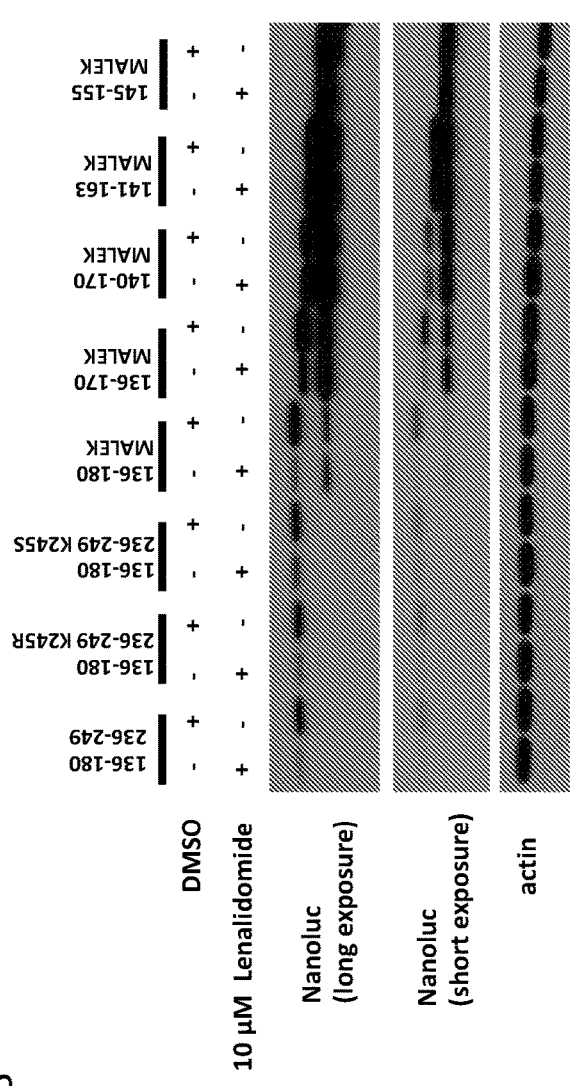
FIG. 3B is a Western blot showing results from studies testing lenalidomide-dependent degradation of NanoLuciferase fused to various IKZF3-based degradation tags. The IKZF3-based degradation tags were fused to the N-terminus of NanoLuciferase, cloned into pNL1.1CMV vectors, and transfected into HEK293T cells. The transfected cells were treated with either DMSO or 10 µM lenalidomide for 4 hours before analyzed by Western blot. Two exposures (a long and a short exposure were shown for NanoLuciferase ("Nanoluc"). IKZF3 136-180 and 236-249, IKZF3 136-180 and 236-249 K245R, IKZF3 136-180 and 236-249 K245S, IKZF3 136-180 MALEK, and IKZF3 136-170 MALEK all facilitated lenalidomide-induced degradation, whereas IKZF3 140-170 MALEK, IKZF3 141-163 MALEK, and IKZF3 145-155 MALEK did not mediate lenalidomide induced degradation.

In a first study, IKZF3 136-180 and 236-249 (a tag comprising the amino acid sequence of SEQ ID NO: 3) facilitated lenalidomide-dependent degradation of NanoLuciferase (FIG. 3B). Mutating the lysine residue at position 245 (numbered according to SEQ ID NO: 19) to arginine (a tag comprising the amino acid sequence of SEQ ID NO: 84) or serine (a tag comprising the amino acid sequence of SEQ ID NO: 100) did not significantly impact the ability of the tag to mediate degradation (FIG. 3B). Similarly, IKZF3 136-180 MALEK (a tag comprising the amino acid sequence of SEQ ID NO: 85) and IKZF3 136-170 MALEK (a tag comprising the amino acid sequence of SEQ ID NO: 86), where residues 236-249 (numbered according to SEQ ID NO: 19) were replaced with helix MALEKMALEKMALE (SEQ ID NO: 91), also retained the ability to facilitate lenalidomide-dependent degradation (FIG. 3B). In contrast, IKZF3 140-170 MALEK (a tag comprising the amino acid sequence of SEQ ID NO: 87), IKZF3 141-163 MALEK (a tag comprising the amino acid sequence of SEQ ID NO: 88), and IKZF3 145-155 MALEK (a tag comprising the amino acid sequence of SEQ ID NO: 89) did not mediate lenalidomide-induced degradation (FIG. 3B), suggesting that at least the first four amino acids HKRS (SEQ ID NO: 40) (positions 136-139, numbered according to SEQ ID NO: 19) are required for degradation.

Figure 4B:
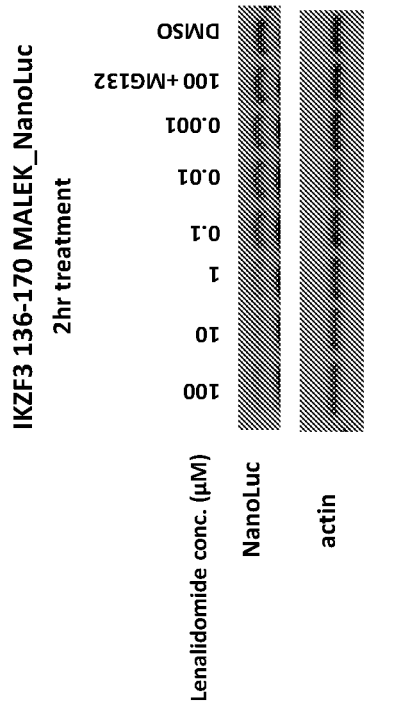
FIGS. 4A and 4B are Western blot graphs showing lenalidomide-dependent degradation of IKZF3 136-180-tagged NanoLuciferase (FIG. 4A) or IKZF3 136-170 MALEK-tagged NanoLuciferase (FIG. 4B) in HEK293T cells, with an IC50 of approximately 100 nM with a 2-hour lenalidomide treatment in both cases. The tagged NanoLuciferase fusions were expressed using pNL1.1CMV constructs.
Figure 4A:
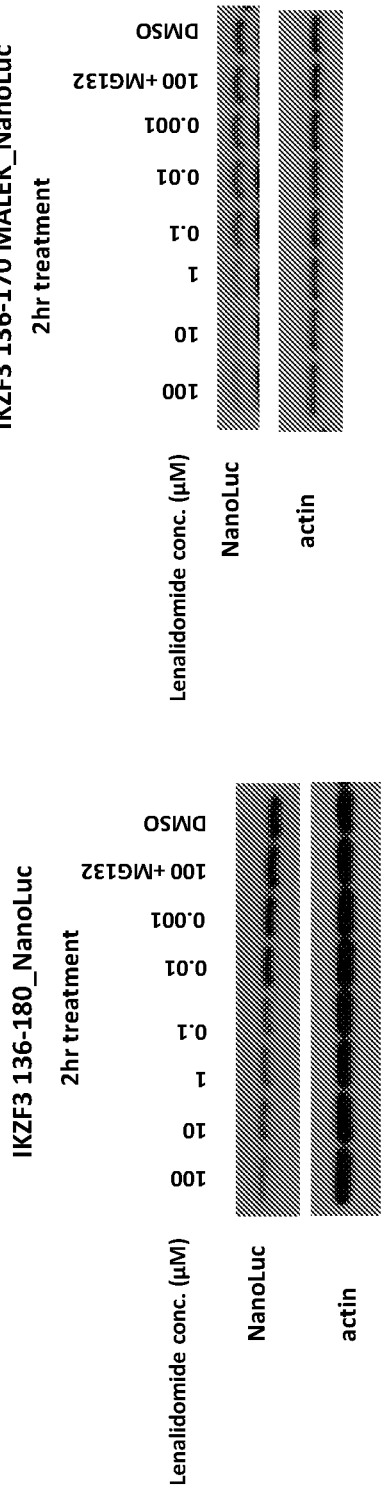
Figure 4C:
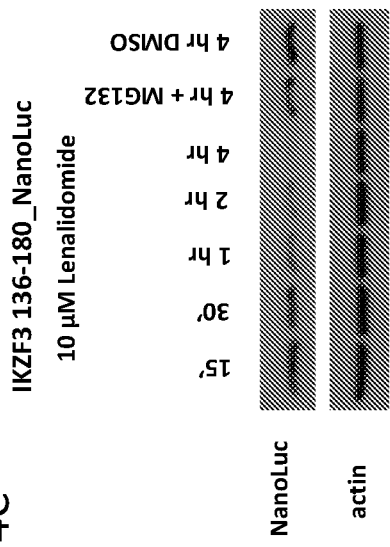
FIG. 4C is a Western blot showing a time-course of lenalidomide-dependent degradation of IKZF3 136-180-tagged NanoLuciferase in HEK293T cells showing degradation as soon as 1 hour and near complete degradation by 4 hours. The tagged NanoLuciferase fusion was expressed using a pNL1.1CMV construct.

In a second study, cells expressing IKZF3 136-180-tagged NanoLuciferase or IKZF3 136-170 MALEK-tagged Nano-Luciferase were treated with various doses of lenalidomide for 2 hours and analyzed using Western blot as described above. Both tags were able to mediate lenalidomide-dependent degradation (FIGS. 4A and 4B). The level of degradation increased as the concentrations of lenalidomide increased (FIGS. 4A and 4B). In addition, cells expressing IKZF3 136-180-tagged NanoLuciferase were treated with 10 µM of lenalidomide for increasing amounts of time before Western blot analysis. Degradation was evident as early as 1 hour and was close to complete by 4 hours (FIG. 4C).

Example 4: Evaluation of IKZF3-Based Degradation Tags Joined to Transcription Factors IKZF3-based degradation tags were evaluated for their ability to facilitate the degradation of melanogenesis associated transcription factor (MITF) or avian myelocytomatosis viral oncogene (MYC) homolog by Western blot. In addition to the IKZF3-based degradation tags, MITF and MYC were also fused to a FLAG tag to facilitate their detection using an anti-FLAG antibody.

Figure 5A:
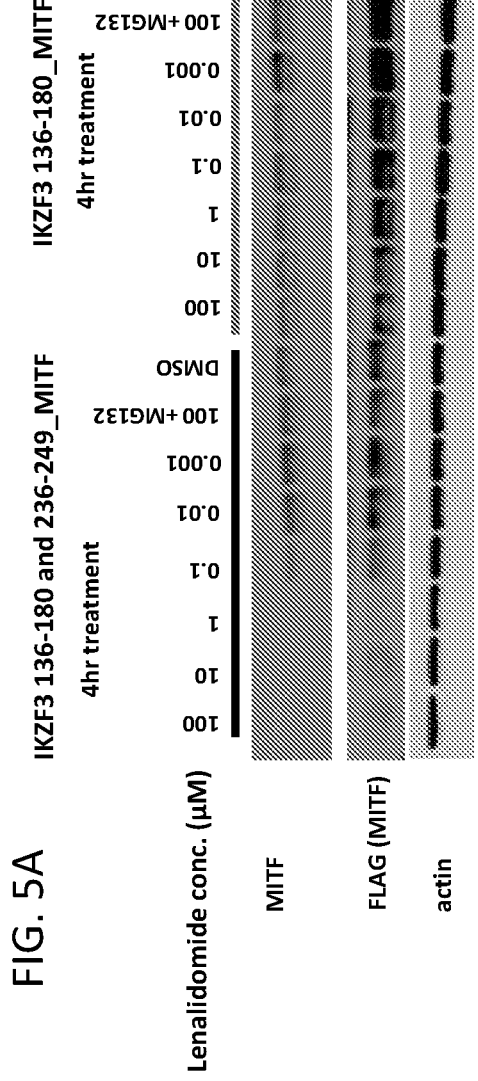
FIG. 5A is a Western blot showing lenalidomide-dependent degradation of IKZF3 136-180 and 236-249-tagged melanogenesis associated transcription factor (MITF) (left panel) as well as IKZF3 136-180-tagged MITF (right panel). The tagged MITF fusions were transfected into HEK293T using pNL1.1CMV constructs. The degradation of IKZF3 136-180 and 236-249-tagged MITF shows an IC50 of ~100 nM. This degradation depended on the activity of proteasome as the degradation was blocked by MG132 treatment. IKZF3 136-180 also mediated lenalidomide-dependent degradation, although to a lesser degree than IKZF3 136-180 and 236-249.
Figure 5B:
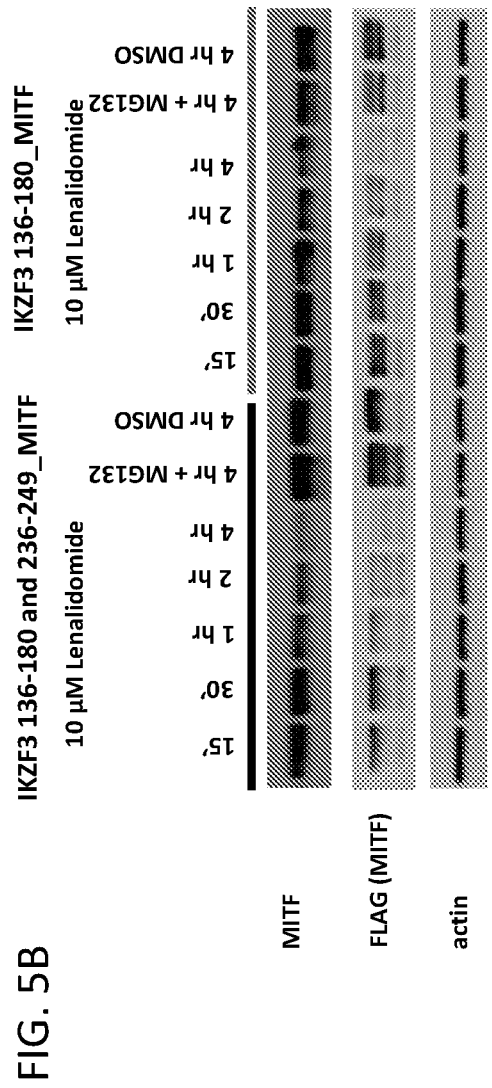
FIG. 5B is a Western blot showing lenalidomide-dependent degradation of IKZF3 136-180 and 236-249-tagged MITF (left panel) as well as IKZF3 136-180-tagged MITF (right panel) after cells expressing these fusion proteins were treated with 10 μM of lenalidomide for various amounts of time. Among the time points tested, the 4-hour treatment shows maximal amount of degradation.

In a first study, IKZF3 136-180 and 236-249-tagged MITF or IKZF3 136-180-tagged MITF was examined for their sensitivity to lenalidomide-dependent degradation. Cells were transfected using pNL1.1CMV constructs encoding the tagged MITF fusions and treated with various concentrations of lenalidomide for 4 hours or treated with 10 µM of lenalidomide for varying amounts of time before the cells were subjected to Western blot analysis. Some cells were treated with MG132 prior to treatment with 100 µM lenalidomide. DMSO was used as vehicle control. As shown in FIGS. 5A and 5B, IKZF3 136-180 and 236-249 was more effective than IKZF3 136-180 in mediating lenalidomide-dependent degradation of MITF. The level of degradation correlated with the concentration of lenalidomide (FIG. 5A) and the length of lenalidomide treatment (FIG. 5B), suggesting that the level of residual target protein levels could be fine-tuned by the dosing the lenalidomide.

In a second study, a lysine free IKZF3 136-180 and 236-249 (a variant of IKZF3 136-180 and 236-249 in which every lysine residue in the tag was mutated to arginine) (a tag comprising the amino acid sequence of SEQ ID NO: 4) was tested for its ability to mediate lenalidomide-dependent degradation. Without wishing to be bound by theory, if the lenalidomide-dependent degradation is mostly mediated via ubiquitination of the target protein (MITF in this example) rather than the IKZF-based tag itself, replacing all the lysine residues in the tag with arginine may not have a significant impact on the level of degradation. As shown in FIGS. 6A, 6B, 6C, and 6D, replacing all the lysine residues in the IKZF3 136-180 and 236-249 degradation tag did not significantly impact the ability of this tag to mediate lenalidomide-dependent degradation of MITF, suggesting that degradation of tagged MITF was mostly through ubiquitination of MITF, rather than the tag itself. Both lenalidomide and pomalidomide effectively facilitated degradation of tagged MITF (FIG. 6D).

Figure 7:
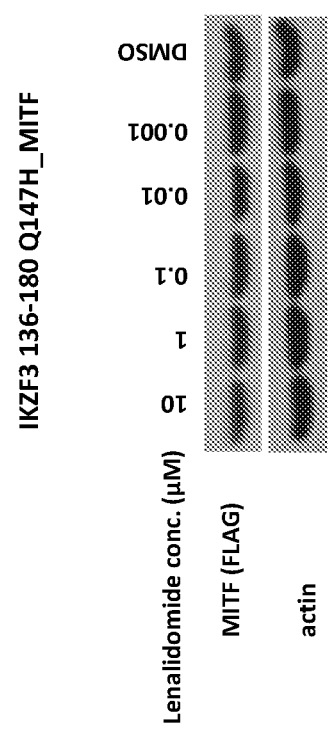
FIG. 7 is a Western blot showing lenalidomide-dependent degradation of IKZF3 136-180 Q147H-tagged MITF. HEK293T cells transfected with pNL1.1CMV constructs encoding the tagged MITF fusions were treated with various lenalidomide doses for 24 hours. IKZF3 136-180 Q147H-tagged MITF did not show degradation in the presence of lenalidomide.

In a third study, IKZF3 136-180 Q147H (a variant of IKZF3 136-180 in which the glutamine residue at position 147, numbered based on SEQ ID NO: 19, was replaced with histidine) (SEQ ID NO: 27) was tested. Glutamine at position 147 has been shown to be essential for IMiD-induced CRBN binding and degradation of IKZF1 or IKZF3 (Kronke et al., Science. 2014 Jan. 17; 343(6168):301-5, incorporated herein by reference in its entirety). As expected, the Q147H substitution blocked the ability of IKZF3 136-180 to mediate the lenalidomide-dependent degradation of MITF (FIG. 7).

Figure 8:
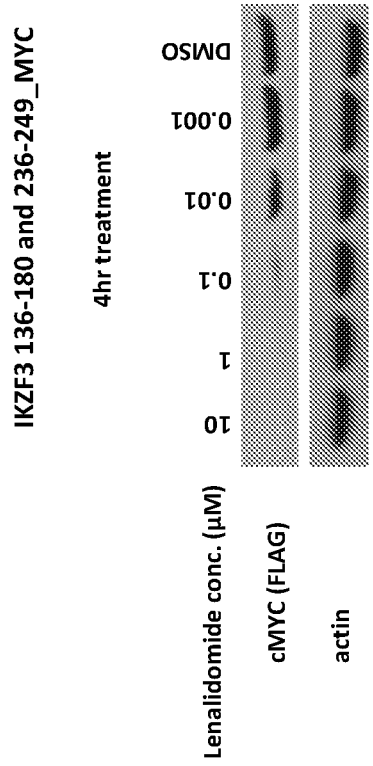
FIG. 8 is a Western blot showing lenalidomide-dependent degradation of IKZF3 136-180 and 236-249-tagged avian myelocytomatosis viral oncogene (MYC) homolog with an IC50 of approximately 10 nM. HEK293T cells expressing tagged MYC fusions using pNL1.1CMV constructs were treated with various lenalidomide doses for 4 hours.
Figure 9A:
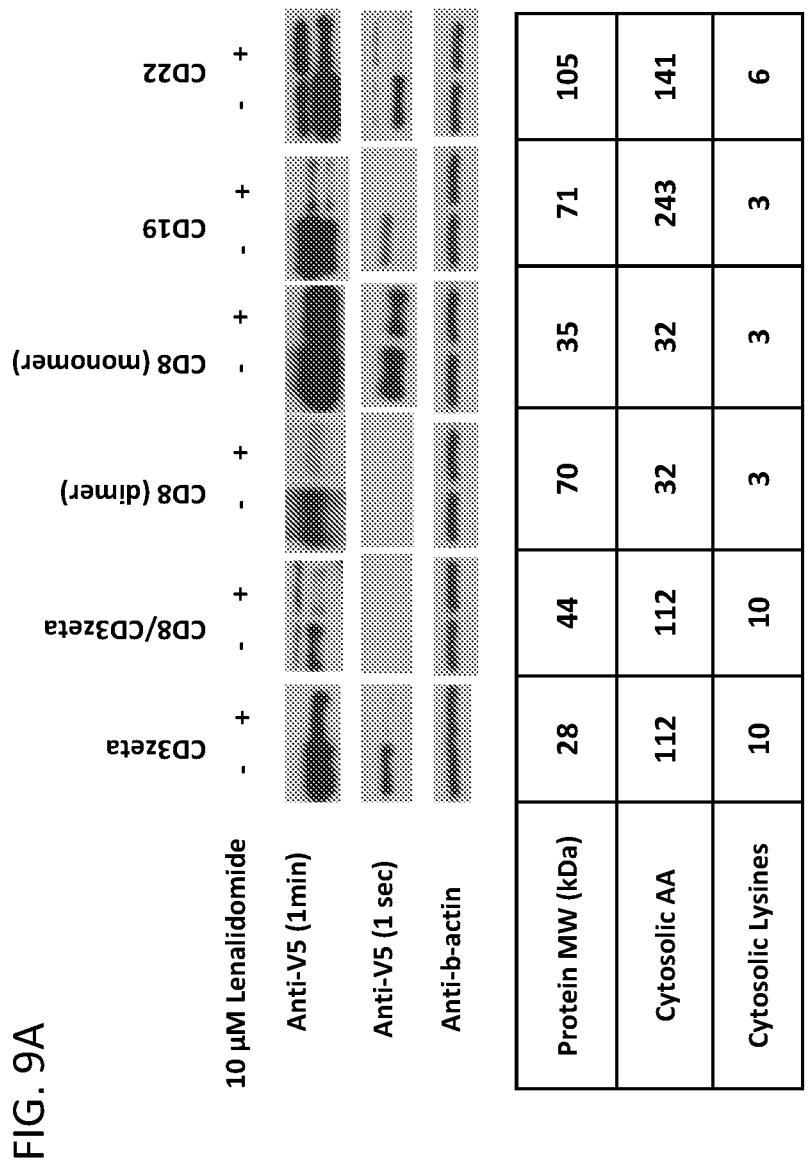
FIG. 9A is a Western blot showing 4-hour lenalidomide-dependent degradation of C-terminally degron-tagged single-pass membrane proteins, CD3zeta, CD8/CD3zeta chimera, CD8, CD19, and CD22. Jurkat cells were infected with pNGX_LV_V002-CDx-IKZF3 136-180 and 236-249 construct virus, selected with G418, and treated with 10 μM lenalidomide or DMSO. Shown in FIG. 9A is staining using an anti-V5 antibody (both a long 1 min exposure and a short 1 second exposure are shown) and an anti-beta-actin antibody. All of the constructs were expressed and degraded with 10 μM lenalinomide treatment. The table in FIG. 9A shows the protein molecular weight (MW), number of cytosolic amino acid residues ("cytosolic AA"), and number of cytosolic lysines for each protein. Interestingly, degradation correlates better with the total number of cytoplasmic amino acids ("AA") than with the number of cytosolic lysine residues.
Figure 9C:
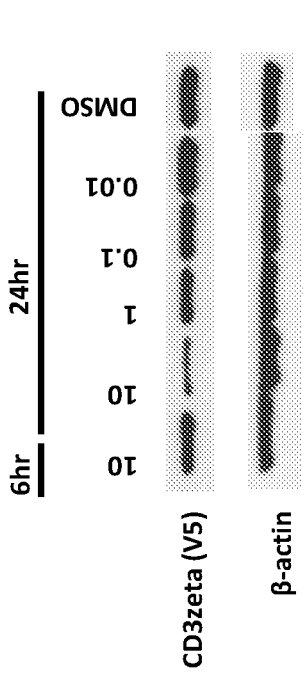
FIGS. 9B, 9C, and 9D are Western blot graphs showing lenalidomide-dependent degradation of the C-terminally tagged CD19 (FIG. 9B), C-terminally tagged CD3zeta (FIG. 9C), and C-terminally tagged CD8/CD3zeta (FIG. 9D). Cells expressing IKZF3 136-180 and 236-249-tagged CD19, CD3zeta, or CD8/CD3zeta were treated with 10 μM of lenalidomide for 6 hours or various lenalidomide doses for 24 hours.
Figure 9B:
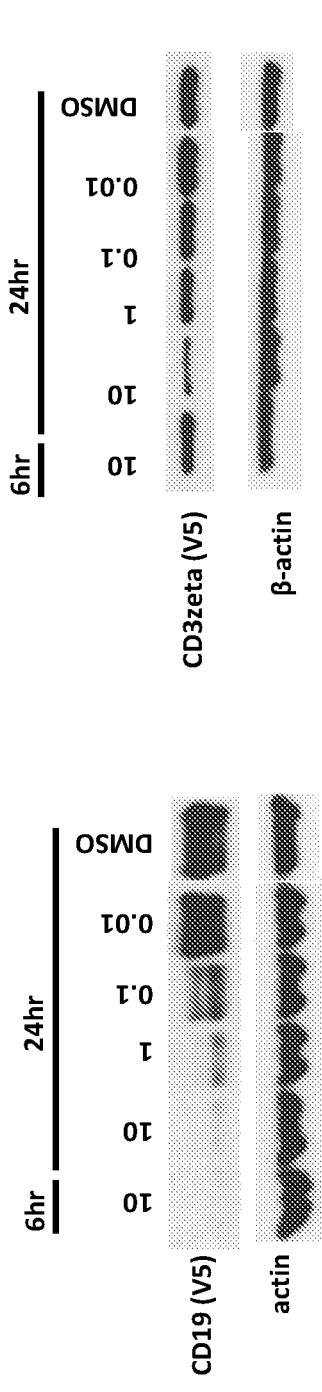
Figure 9D:
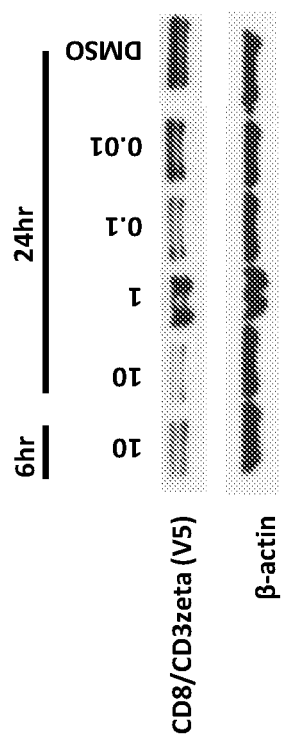

In a fourth study, IKZF3 136-180 and 236-249 was examined for its ability to mediate lenalidomide-dependent degradation of another transcription factor avian myelocytomatosis viral oncogene (MYC) homolog. HEK293T cells transfected with a fusion molecule, in which IKZF3 136-180 and 236-249 was fused to the N-terminus of MYC, were treated with various concentrations of lenalidomide for 4 hours. The levels of tagged MYC, which was also fused to an FLAG tag, was assessed by Western blot using an anti-FLAG antibody. As shown in FIG. 8, IKZF3 136-180 and 236-249 also mediated the lenalidomide-dependent degradation of tagged MYC. The level of degradation correlated with the concentration of lenalidomide (FIG. 8).

Example 5: Evaluation of IKZF3-Based Degradation Tags Joined to Transmembrane Proteins by Western Blot The ability of IKZF3-based degradation tags to facilitate lenalidomide-dependent degradation of the single-pass membrane, cell surface proteins CD3zeta, CD8, CD8/CD3zeta, CD19, and CD22 was evaluated. The IKZF3 136-180 and 236-249 tag (a tag comprising the amino acid sequence of SEQ ID NO: 2) was fused to the C-terminus of the single-pass membrane proteins using the 16GS linker GGGGSGGGGTGGGGSG (SEQ ID NO: 28). Viruses were generated from IKZF3 136-180 and 236-249-tagged CD3zeta, CD8, CD8/CD3zeta, CD19, and CD22 maxi preps purchased from Genewiz. Stable Jurkat cell lines were transduced with the viruses and treated with 10 µM of lenalidomide for 4 hours prior to analysis by Western blot. All the tagged membrane proteins further comprise a V5 tag to facilitate their detection using an anti-V5 antibody.

As shown in FIGS. 9A, 9B, 9C, and 9D, all the constructs tested were sensitive to lenalidomide-dependent degradation, although the level of sensitivity varied among the constructs. Interestingly, there seems to be a correlation between the level of lenalidomide-dependent degradation and the number of cytosolic amino acids in the target protein (FIG. 9A), as target proteins with more amino acids in the cytosol were degraded to a greater extent.

Overall, these data suggest that IKZF3-based degradation tags may be able to mediate the degradation of CD proteins (and single-pass membrane proteins in general) in the presence of lenalidomide.

Example 6: Evaluation of IKZF3-Based Degradation Tags Joined to Transmembrane Proteins by Flow Cytometry The dose-responsive effect of lenalidomide treatment on target proteins fused to IKZF3-based degradation tags was evaluated by flow cytometry. In particular, flow cytometry analysis was conducted to determine whether there was a difference between the total amount of target protein degraded and the total amount of target protein expressed on the cell surface.

Jurkat cells expressing IKZF3 136-180 and 236-249-tagged CD19 were analyzed by flow cytometry at 0, 1, 6, 16, and 24 hours post treatment with 1 µM or 10 µM lenalidomide. CD19 was stained with anti-human CD19 antibody (BD Pharmingen 555413).

Figure 10B:
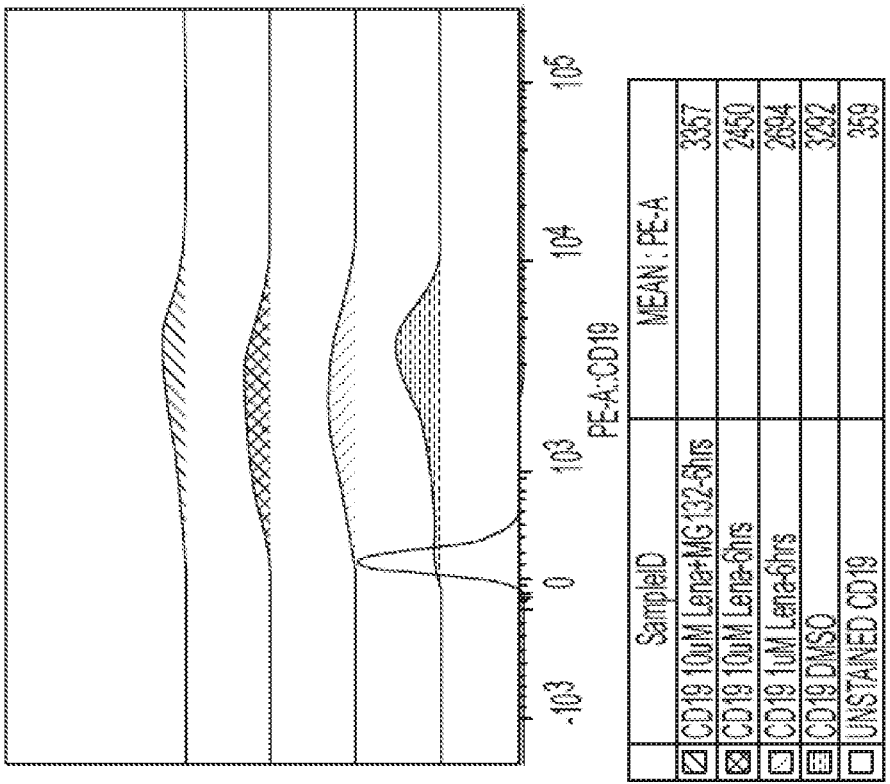
FIGS. 10A, 10B, 10C, and 10D are a series of flow cytometry histograms comparing IKZF3 136-180 and 236-249-tagged CD19 cell surface expression on Jurkat cells that were treated with 1 μM or 10 lenalidomide for 1 hour (FIG. 10A), 6 hours (FIG. 10B), 16 hours (FIG. 10C), or 24 hours (FIG. 10D). Some cells were pre-treated with 10 μM MG132 prior to treatment with 10 μM lenalidomide. DMSO served as vehicle control. IKZF3 136-180 and 236-249 was fused to the C-terminus of CD19.
Figure 10A:
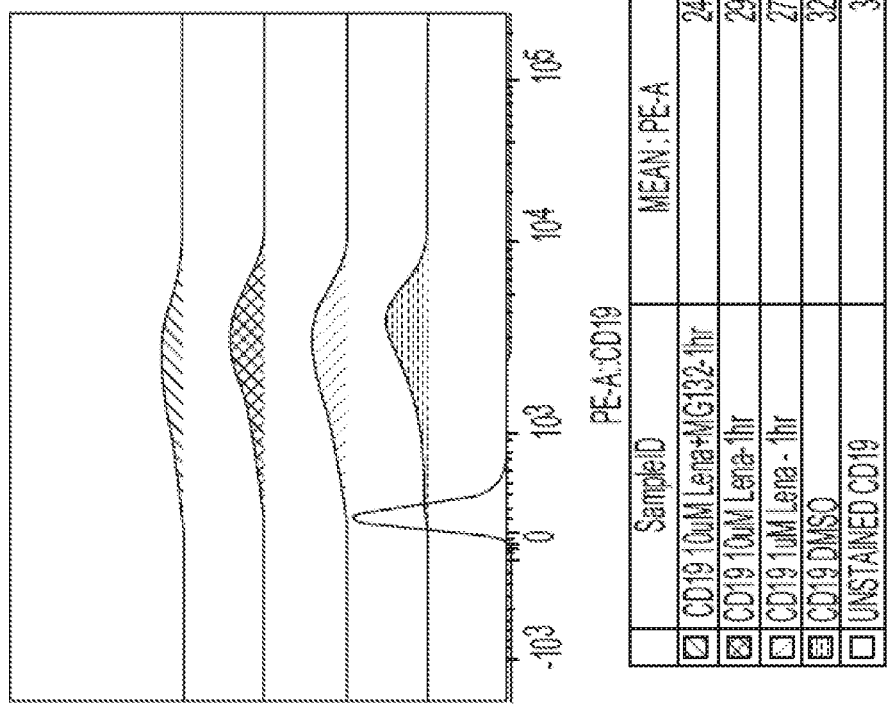
Figure 10C:
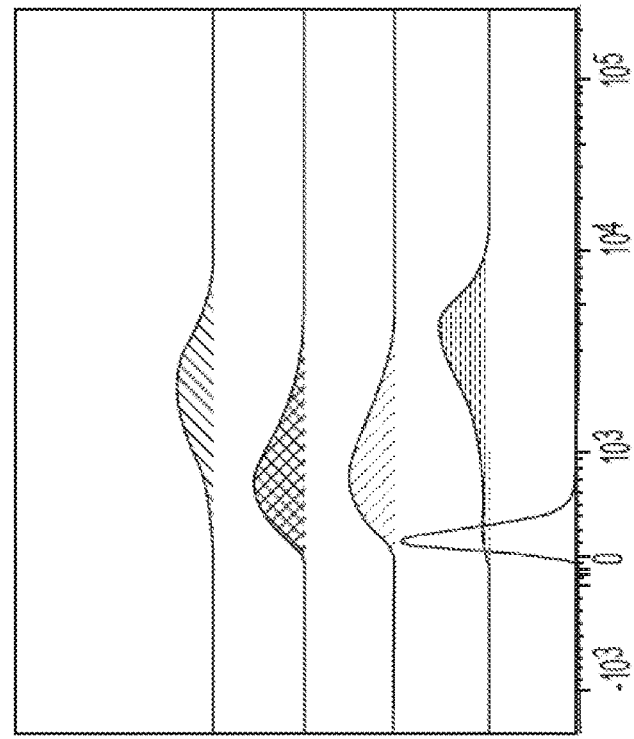
Figure 10D:
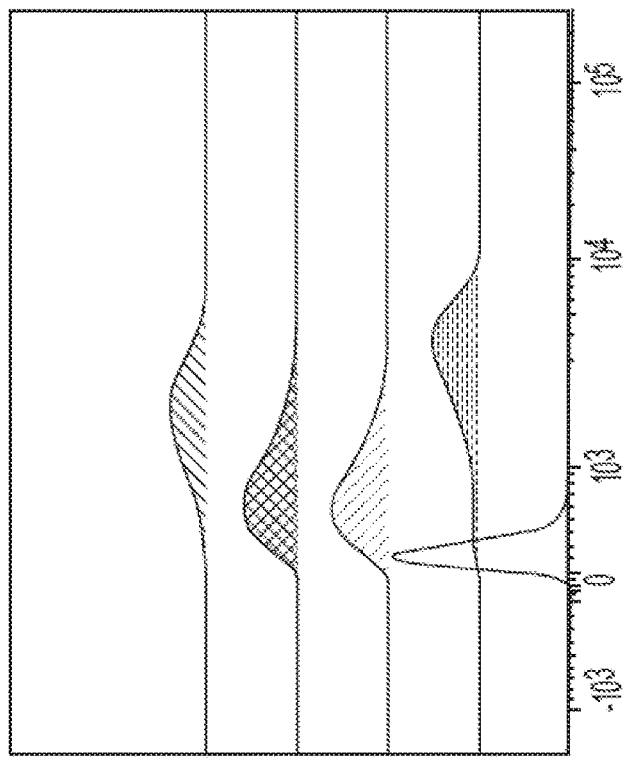
Figure 10E:
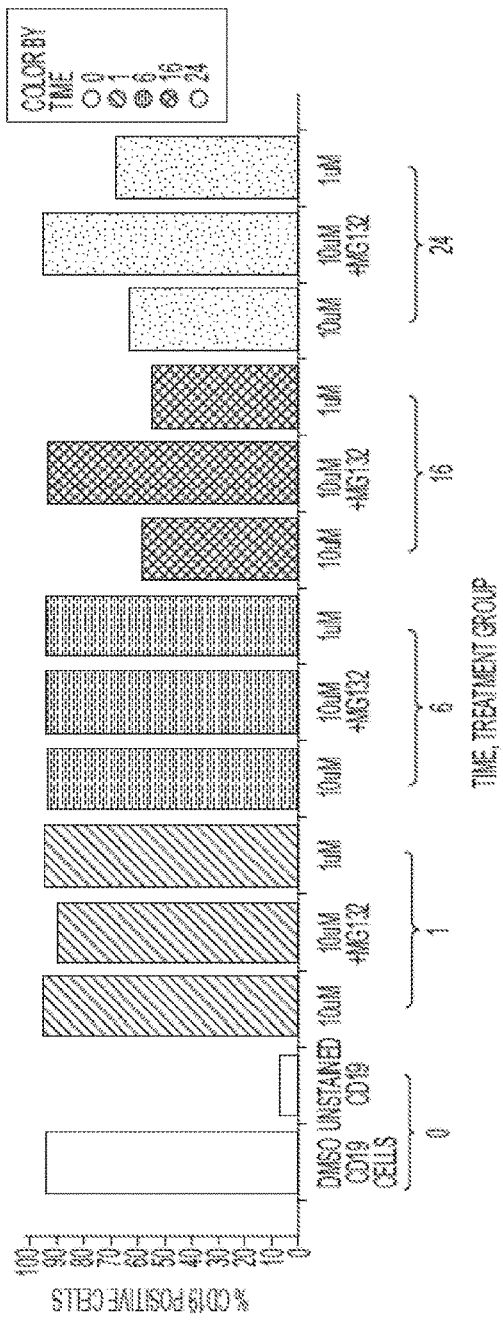
FIGS. 10E and 10F are bar graphs showing the % CD19 positive cells (FIG. 10E) or mean fluorescence intensity (MFI) of CD19 positive cells (FIG. 10F) across all lenalidomide doses and time points tested. There was minimal degradation at 1 hour and minor degradation at 6 hours. The degradation was much more evident at 16 and 24 hours in both the 1 μM and 10 μM treatment groups and this degradation could be partially blocked by the proteasome inhibitor MG132. There was approximately 50% reduction of CD19 positive cells at 16 hours in both the 1 μM and 10 μM treatment groups (FIG. 10E), and this reduction corresponded with a reduction in MFI (FIG. 10F).
Figure 10F:
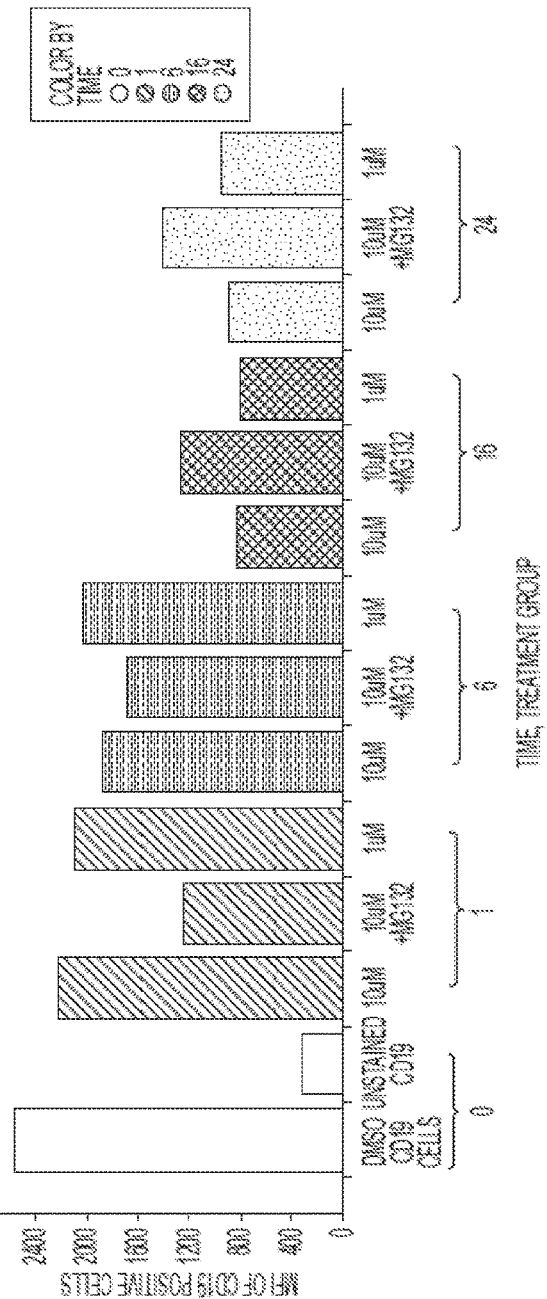

90% of transduced Jurkat cells expressed CD19 on the surface, with no detectable CD19 expression on parental Jurkat cells (FIG. 10E). A reduction in mean fluorescence intensity (MFI) and percentage of CD19 expression was observed after cells were treated with lenalidomide for 16 hours or 24 hours, which can be blocked by MG132 treatment (FIGS. 10C, 10D, 10E, and 10F). This differs from what was seen in the western blot analysis described in Example 5, which shows major reduction in CD19 levels after a 6-hour, 10 µM lenalidomide treatment.

These data show that an IKZF3-based degradation tag can be used to selectively degrade single-pass transmembrane proteins.

Figure 11:
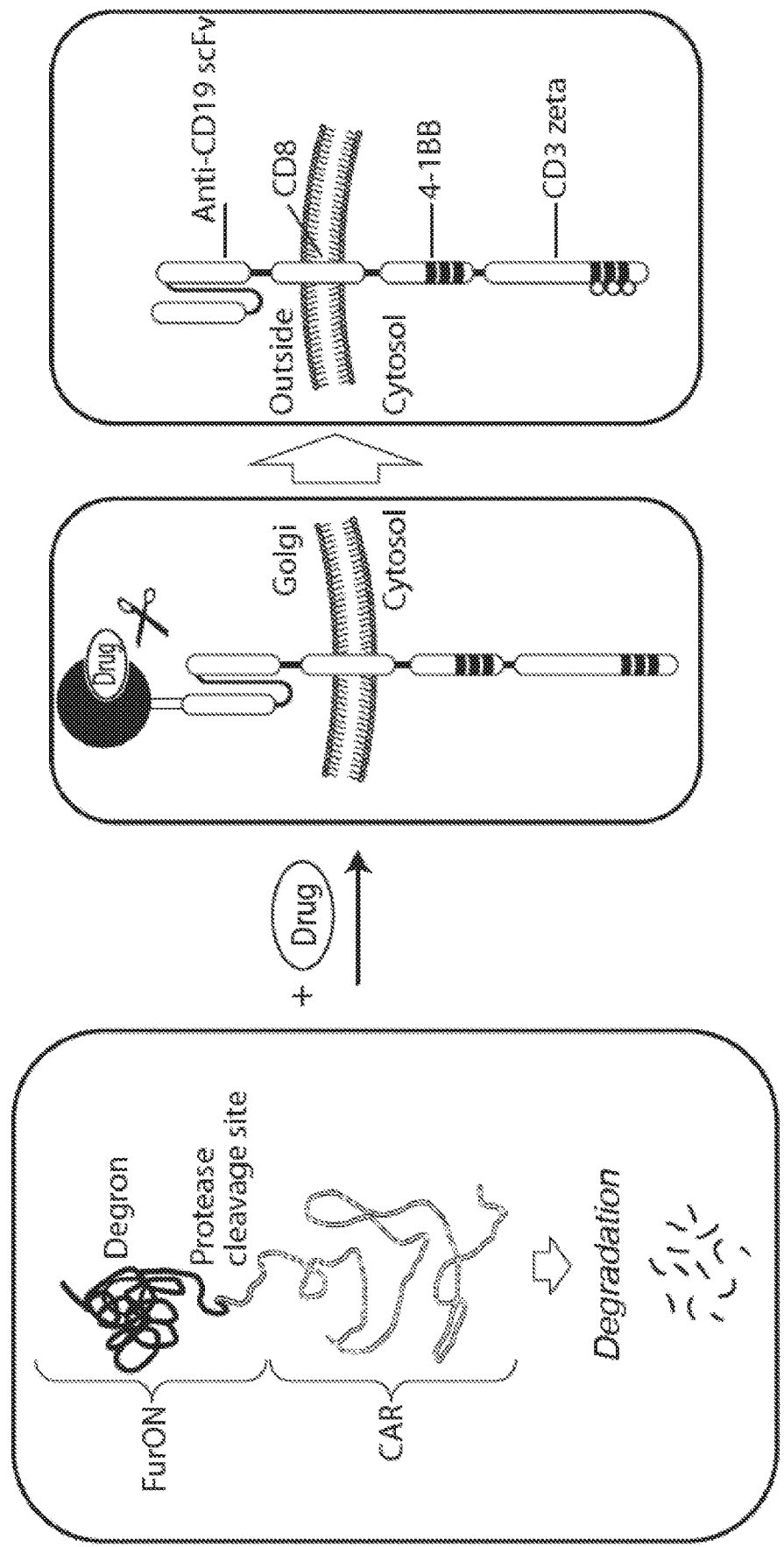
FIG. 11 is a schematic showing an exemplary fusion protein comprising a degradation domain (degron), protease cleavage site, and a second protein domain (a CAR), and the change in degradation of the fusion protein in the presence of a drug, e.g., stabilization compound.

Example 7: Evaluation of Chimeric Antigen Receptors (CARs) Fused to HilD Tag and/or FurON by Western Blot In this example, anti-CD19 chimeric antigen receptor CAR19 was modified with the HilD tag and/or a furin degron (FurON). FurON can serve as a switch when fused to a CAR molecule. FurON comprises two components: (1) a degron or degradation domain, which is a mutated protein domain unable to acquire a proper conformation in the absence of a small molecule ligand (e.g., bazedoxifene), and (2) a furin cleavage site (FIG. 11). Without wishing to be bound by theory, in the absence of the small molecule ligand (e.g., bazedoxifene), the misfolded/unfolded degradation domain can be degraded by intracellular degradation pathways along with the CAR molecule that is fused to the degradation domain (FIG. 11). In the presence of the small molecule ligand (e.g., bazedoxifene), the degradation domain assumes a proper conformation, leading to the exposure of the furin cleavage site and removal of the degradation domain (FIG. 11). In some embodiments, the FurON switch can be combined with the HilD switch (FIG. 12C). Combining these two switches could increase the speed of turning off CAR expression and activity in the presence of toxicities (FIG. 12C).

Polynucleotide sequences encoding HilD tagged CAR19 were cloned into pNGx-LV_v002 lenti-viral expression vector. gBlocks were ordered from IDT. Table 24 provides information on these gBlocks. Construct 765 comprises, from N-terminus to C-terminus, a signal peptide, FurOn, and CAR19. Construct 766 comprises, from N-terminus to C-terminus, a signal peptide, FurON, CAR19, a 16GS linker, the HilD tag, and a V5. Construct 767 comprises, from N-terminus to C-terminus, a signal peptide, FurON, CAR19, a 16GS linker, and the HilD tag. Construct 768 comprises, from N-terminus to C-terminus, a signal peptide, CAR19, a 16GS linker, the HilD tag, and a V5. Construct 769 comprises, from N-terminus to C-terminus, a signal peptide, CAR19, a 16GS linker, and the HilD tag. Construct 770 comprises, from N-terminus to C-terminus, a signal peptide, CAR19, a 16GS linker, and a lysine free HilD tag. In the lysine free HilD tag (shown as "HilD tag_NoK" in Table 24), every lysine residue in the tag has been replaced by arginine. Construct 771 comprises, from N-terminus to C-terminus, a signal peptide, CAR19, the HilD tag, and a V5. Construct 6761 comprises, from N-terminus to C-terminus, a signal peptide, CAR19, a 16KGS linker, the HilD tag, and a V5. Construct 773 comprises, from N-terminus to C-terminus, a modified signal peptide, the HilD tag, a furin cleavage site, and CAR19. Construct 774 comprises, from N-terminus to C-terminus, a signal peptide, the HilD tag, a furin cleavage site, and CAR19. Briefly, gBlocks were digested, purified using the Qiagen MinElute PCR Purification Kit (cat #28004), and ligated into the pNGx-LV_v002 lenti-viral expression vector. The resultant clones were confirmed by sequencing.

TABLE 24

Components of gBlocks

| Construct # | gBlocks | SEQ ID NO of amino acid sequence (signal peptide included) |
| --- | --- | --- |
| 765 | FurON_CAR19 | SEQ ID NO: 92 |
| 766 | FurON_CAR19_16GS_HilD tag_V5 | SEQ ID NO: 93 |
| 767 | FurON_CAR19_16GS_HilD tag | SEQ ID NO: 32 |
| 768 | CAR19_16GS_HilD tag_V5 | SEQ ID NO: 94 |
| 769 | CAR19_16GS_HilD tag | SEQ ID NO: 30 |
| 770 | CAR19_16GS_HilD tag_NoK | SEQ ID NO: 31 |
| 771 | CAR19_HilD tag_V5 | SEQ ID NO: 95 |
| 6761 | CAR19_16KGS_HilD tag_V5 | SEQ ID NO: 96 |
| 773 | HilD tag_CAR19_modSigPep | SEQ ID NO: 97 |
| 774 | HilD tag_CAR19 | SEQ ID NO: 98 |

Viruses were prepared from maxi preps and used to transduce JNL cells. Either 275 µL of viral supernatant or 700 µL of viral supernatant was used for transduction. JNL cells are Jurkat cells engineered with a luciferase gene under control of the NFAT promoter. The transduced JNL cells were examined for CAR expression in the presence or absence of lenalidomide treatment using Western blot.

Briefly, cells were diluted to $0.5 \times 10^6$ in 3 mL total in 6 well dishes. Each cell line was plated into two wells (one for DMSO, one for 10 µM lenalidomide treatment). Bazedoxifene was added at a final concentration of 1 µM to every well that contained a cell line expressing a fusion comprising FurON. For all cell lines, either 10 µM final lenalidomide or DMSO was added. Cells were incubated at 37° C. and 5% $CO_2$ overnight.

24 hours after compound treatment, cells were pelleted, washed with PBS, and lysed with 50 µL RIPA buffer (Boston Bioproducts BP-115D) containing protease inhibitors (Roche 04693124001). Lysates were centrifuged, supernatant transferred to new tubes and protein quantities read by Lowry Assay (BioRad 5000111). Each sample was normalized to 30 µg total protein in a 20 µL volume with 4× sample buffer (Thermo Scientific NP0007) and 10× reducing agent (Thermo Scientific NP0009). Samples were subjected to Western blot analysis using a mouse anti-V5 antibody (Thermo Scientific MA5-15253) at 1:1000 dilution, a mouse anti-actin antibody (Sigma Aldrich A5441) at 1:10000 dilution, and/or a mouse anti-CD3z antibody (BD 551034) at 1:1000 dilution.

As expected, lenalidomide did not have any impact on FurON-CAR19 without the HilD tag (FIG. 13A). In the presence of the HilD tag, treatment with 10 µM lenalidomide almost completely degraded FurON-CAR19 regardless of the presence of the V5 tag (FIGS. 13B and 13C). 10 µM lenalidomide treatment also almost completely degraded all CAR19-HilD constructs regardless of the presence of the 16GS linker or the V5 tag (FIGS. 14A-14C). The lenalidomide-dependent degradation of construct 770 (FIG. 14D), which comprises a lysine free HilD tag (every lysine residue in the HilD tag was replaced with arginine), suggests that degradation of CAR19 was mostly mediated by ubiquitination of CAR19 itself, rather than the HilD tag.

Next, the kinetics of CAR19 degradation as well as the effective lenalidomide doses for reduction of CAR19 expression were examined by Western blot. JNL cells expressing construct 769 (CAR19_16GS_HilD tag) were diluted to $0.5 \times 10^6$ in 3 mL total in 6 well dishes. Each cell line was plated into multiple wells for lenalidomide treatment/time-points. Once cells were plated, the samples were treated with various doses (10 μM, 1 μM, 0.1 μM, 0.01 μM, or 0.001 μM) of lenalidomide or DMSO for different amounts of time. Cells were harvested and subjected to Western blot as described above using a mouse anti-actin antibody (Sigma Aldrich A5441) at 1:10000 dilution or a mouse anti-CD3zeta antibody (BD 551034) at 1:1000 dilution.

Figure 15A:
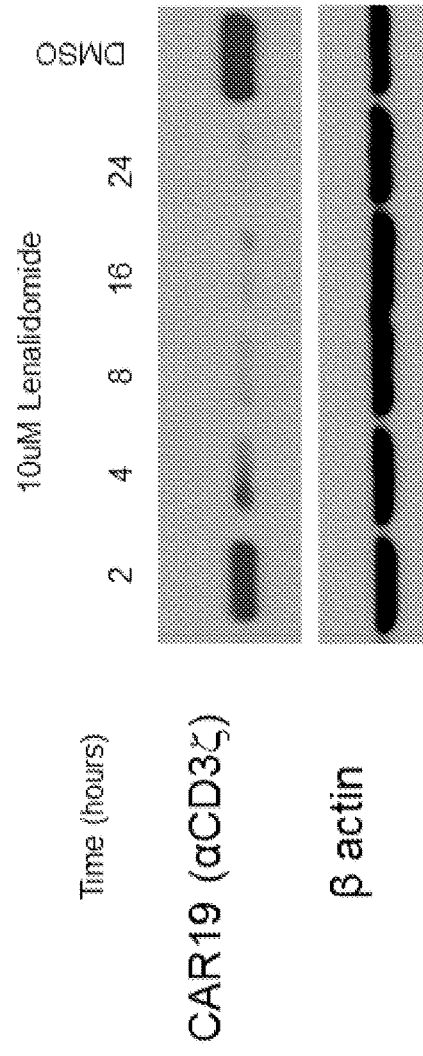
FIGS. 15A and 15B are Western blot graphs showing lenalidomide-dependent degradation of CAR molecules. JNL cells expressing construct 769 (CAR19_16GS_HilD tag) were incubated with 10 μM of lenalidomide or DMSO for 2, 4, 8, 16 or 24 hours (FIG. 15A) or incubated with various doses of lenalidomide or DMSO for 24 hours (FIG. 15B) before Western blot analysis.

10 μM of lenalidomide degraded CAR19-16GS-HilD-tag fusion protein in a time-dependent manner (FIG. 15A). Degradation was evident as early as 4 hours and appeared to reach maximal degradation by 8 hours (FIG. 15A). The level of degradation was stable from 8-24 hours, with no apparent re-bound of protein expression (FIG. 15A).

Figure 15B:
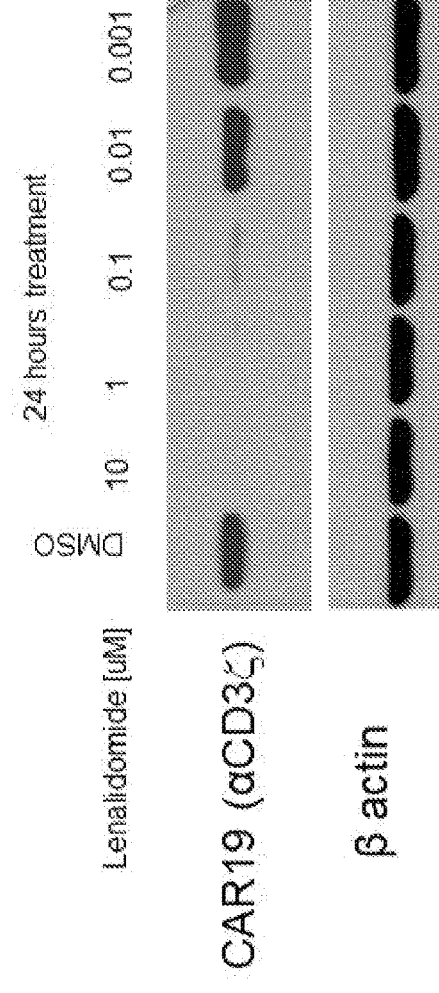

As shown in FIG. 15B, lenalidomide degraded CAR19-16GS-HilD-tag fusion protein at concentrations as low as 100 nM. CAR19 degradation was evident with every dose of compound higher than 100 nM (FIG. 15B), indicating that there was no compound hook-effect. The titration of protein degradation seen at lower lenalidomide concentrations suggests that the degradation is tunable and precise CAR19 levels may be regulated by adjusting the dosing of lenalidomide.

Example 8: Evaluation of Chimeric Antigen Receptors (CARs) Fused to HilD Tag and/or FurON by Flow Cytometry Next, the surface expression of CAR19 on stably transduced JNL cells was examined by flow cytometry. On Day 1, the transduced JNL cells were plated with or without lenalidomide at 10 μM for 24 hours. The cells expressing FurON-CAR19 constructs were cultured with and without lenalidomide in the presence or absence of bazedoxifene. On Day 2, cells were harvested, stained using biotinylated-protein L (Genscript, M00097) followed by PE conjugated streptavidin (Jackson Lab, 016-110-084), and subjected to flow cytometry analysis using Fortessa instrument.

Figure 16A:
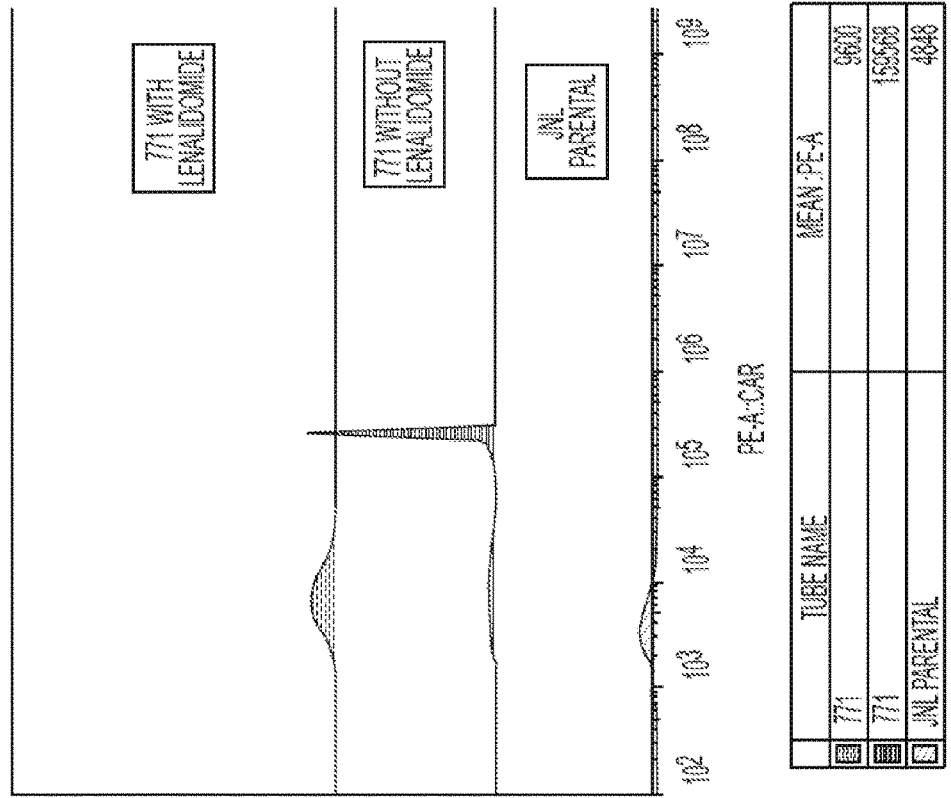
FIGS. 16A, 16B, 16C, 16D, 16E, 16F, and 16G are a set of flow cytometry histograms showing surface CAR expression in the presence or absence of lenalidomide. Constructs tested include: construct 769 (CAR19_16GS_HilD tag) (FIG. 16A), construct 771 (CAR19_HilD tag_V5) (FIG. 16B), construct 6761 (CAR19_16 KGS_HilD tag_V5) (FIG. 16C), construct 768 (CAR19_16GS_HilD tag_V5) (FIG. 16D), construct 770 (CAR19_16GS_HilD tag_NoK) (FIG. 16E), construct 773 (HilD tag_CAR19_modSigPep) (FIG. 16F), and construct 774 (HilD tag_CAR19) (FIG. 16G). JNL cells expressing the indicated constructs were incubated with or without 10 μM lenalidomide for 24 hours and then subjected to flow cytometry analysis.
Figure 16B:
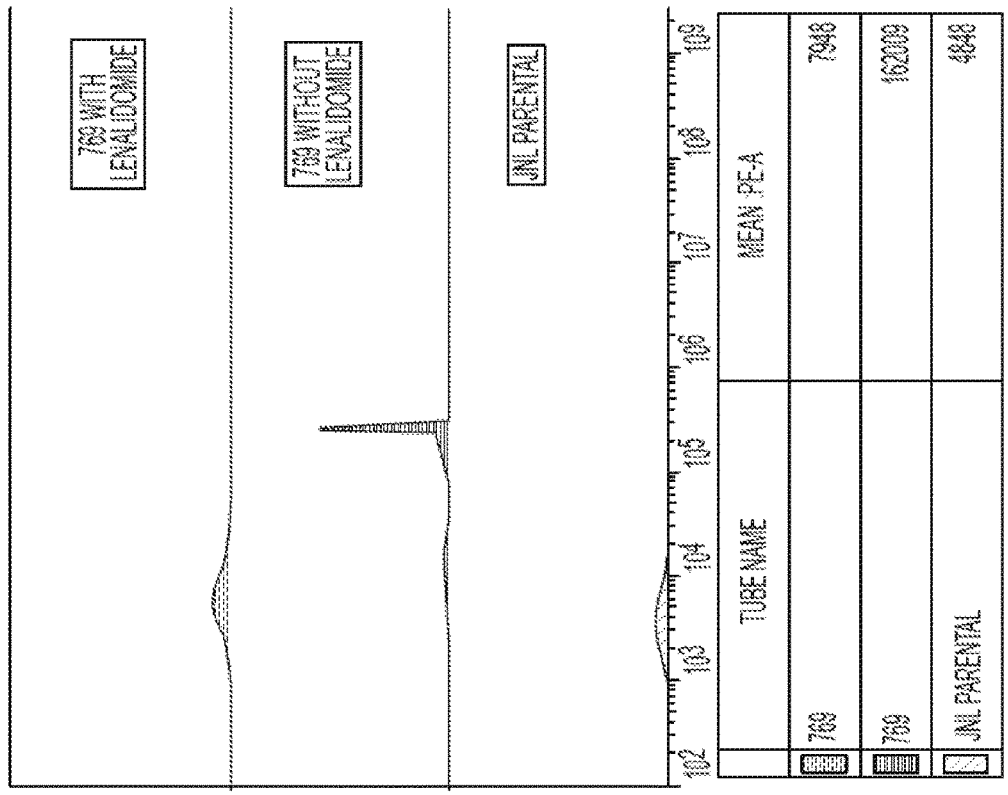
Figure 16D:
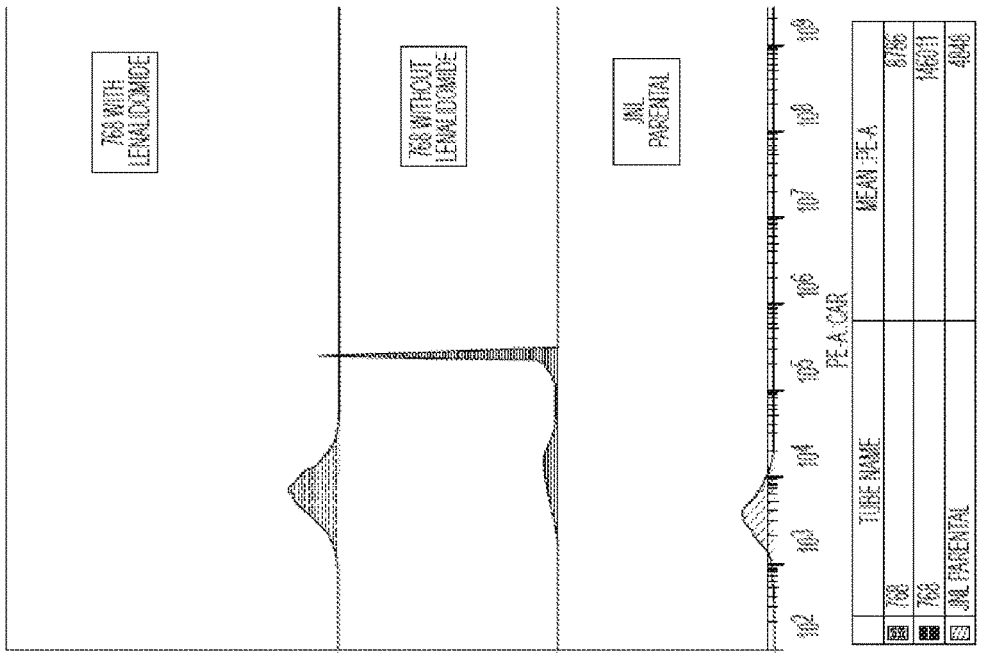
Figure 16C:
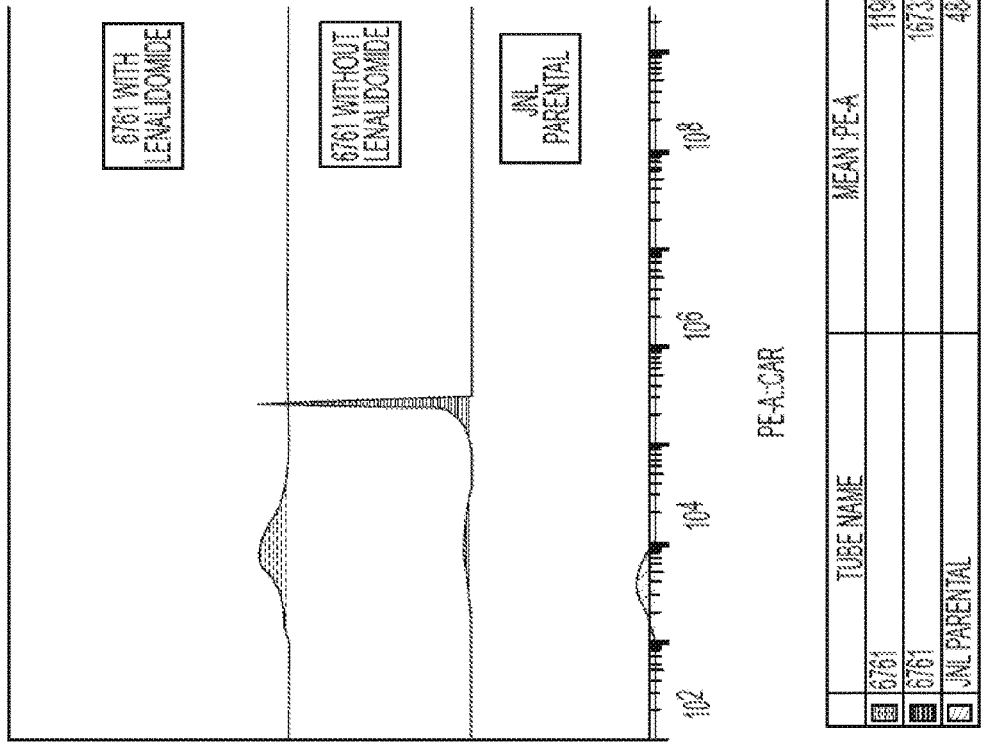
Figure 16E:
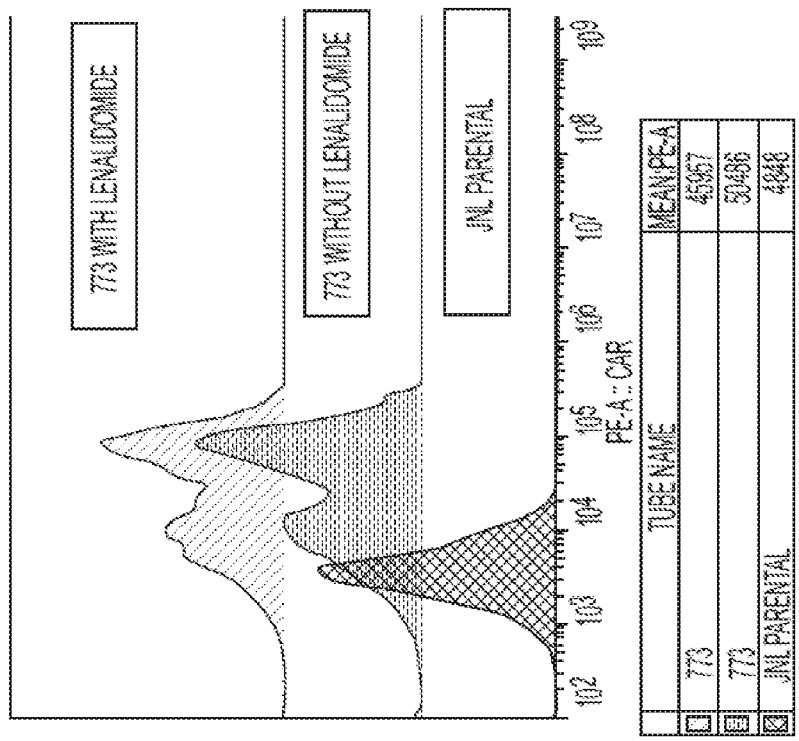

For the molecules in which the HilD tag was fused to the C-terminus of CAR19 (constructs 769, 771, 6761, 768, and 770), the transduced cells showed CAR expression on more than 60% of the cells (FIGS. 16A, 16B, 16C, 16D, and 16E). No CAR expression was detected on parental JNL cells (FIGS. 16A, 16B, 16C, 16D, and 16E). Treatment with 10 μM lenalidomide for 24 hours significantly reduced surface CAR expression (FIGS. 16A, 16B, 16C, 16D, and 16E). Notably, the lysine-free HilD tag also mediated lenalidomide-dependent reduction of surface CAR expression (FIG. 16E).

Figure 16F:
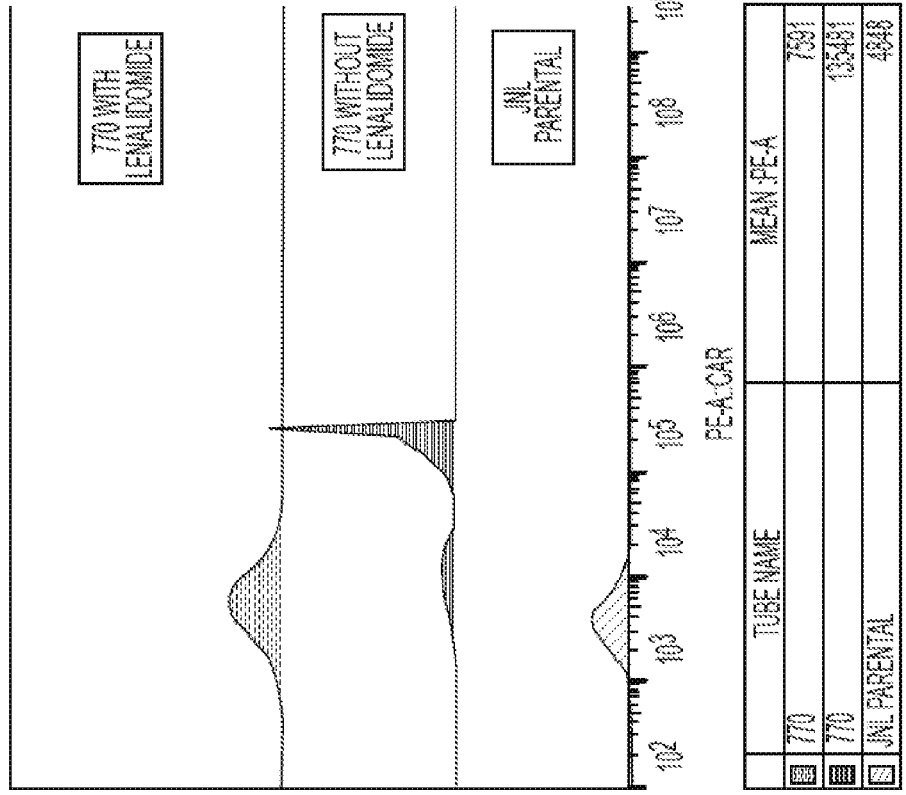
Figure 16G:
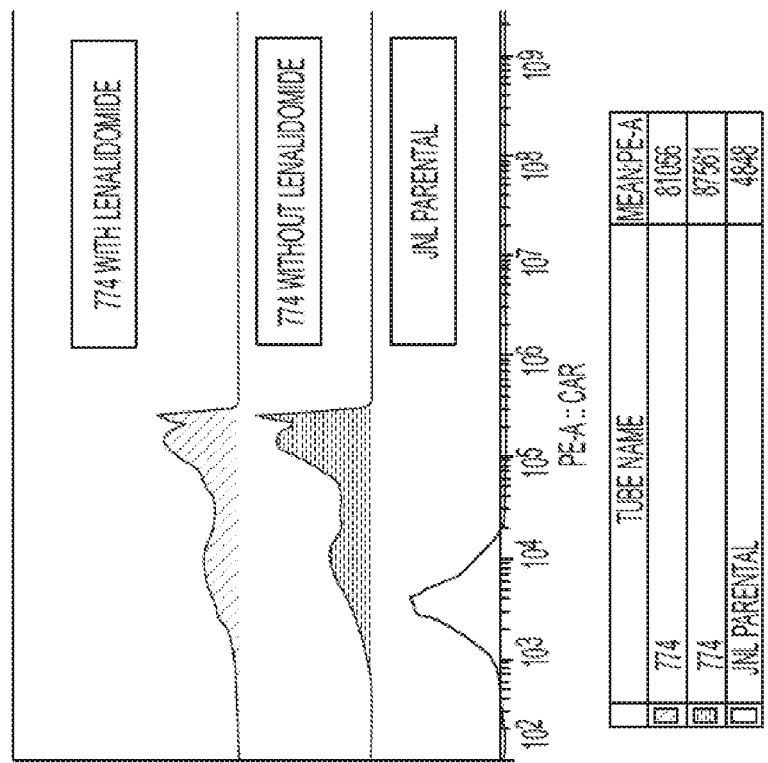

For the molecules in which the HilD tag was fused to a furin cleavage site and then to the N-terminus of CAR19 (constructs 773 and 774), the transduced cells showed CAR expression (FIGS. 16F and 16G). Incubating with 10 μM lenalidomide for 24 hours did not impact surface CAR expression (FIGS. 16F and 16G).

Figure 17A:
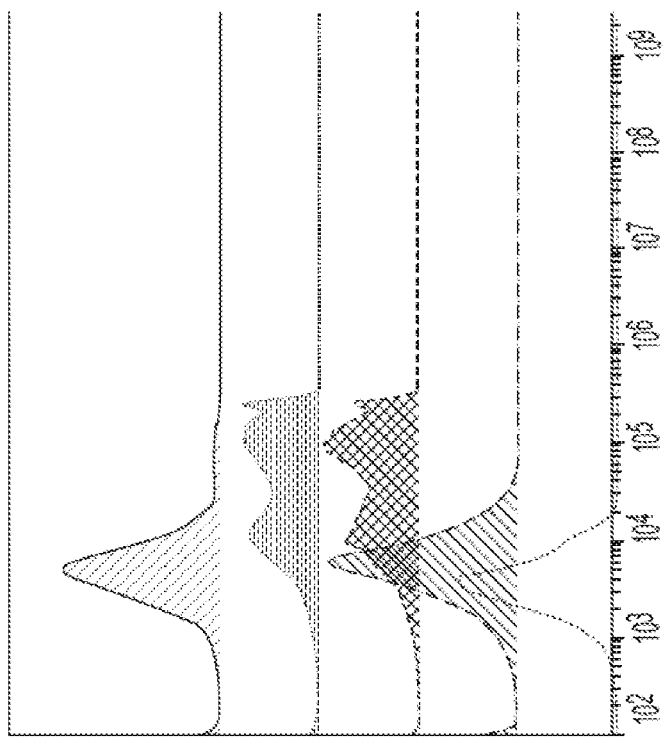
FIGS. 17A, 17B, and 17C are a set of flow cytometry histograms showing surface CAR expression regulated by lenalidomide and/or bazedoxifene (BZA). Constructs tested include: construct 765 (FurON_CAR19) (FIG. 17A), construct 767 (FurON_CAR19_16GS_HilD tag) (FIG. 17B), and construct 766 (FurON_CAR19_16GS_HilD tag_V5) (FIG. 17C). JNL cells expressing the indicated constructs were incubated in the presence or absence of lenalidomide and/or bazedoxifene (BZA) for 24 hours prior to flow cytometry analysis.
Figure 17B:
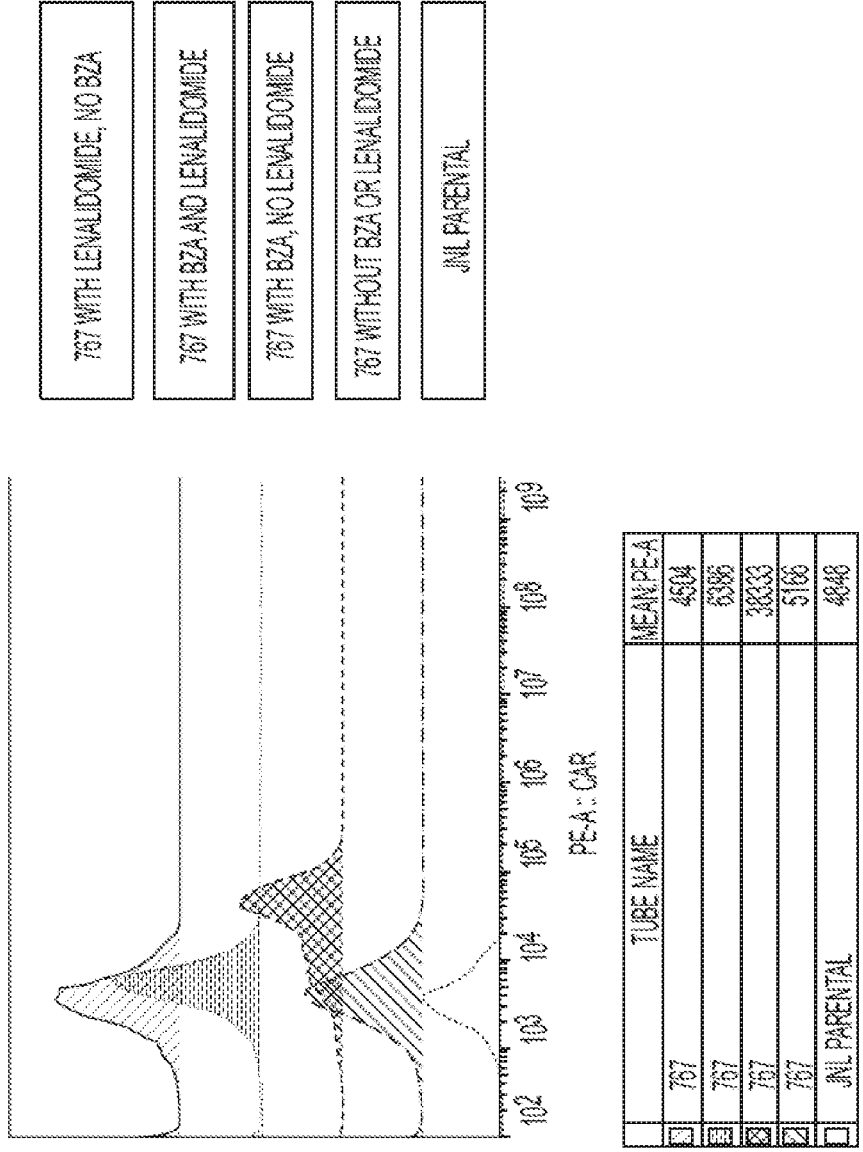
Figure 17C:
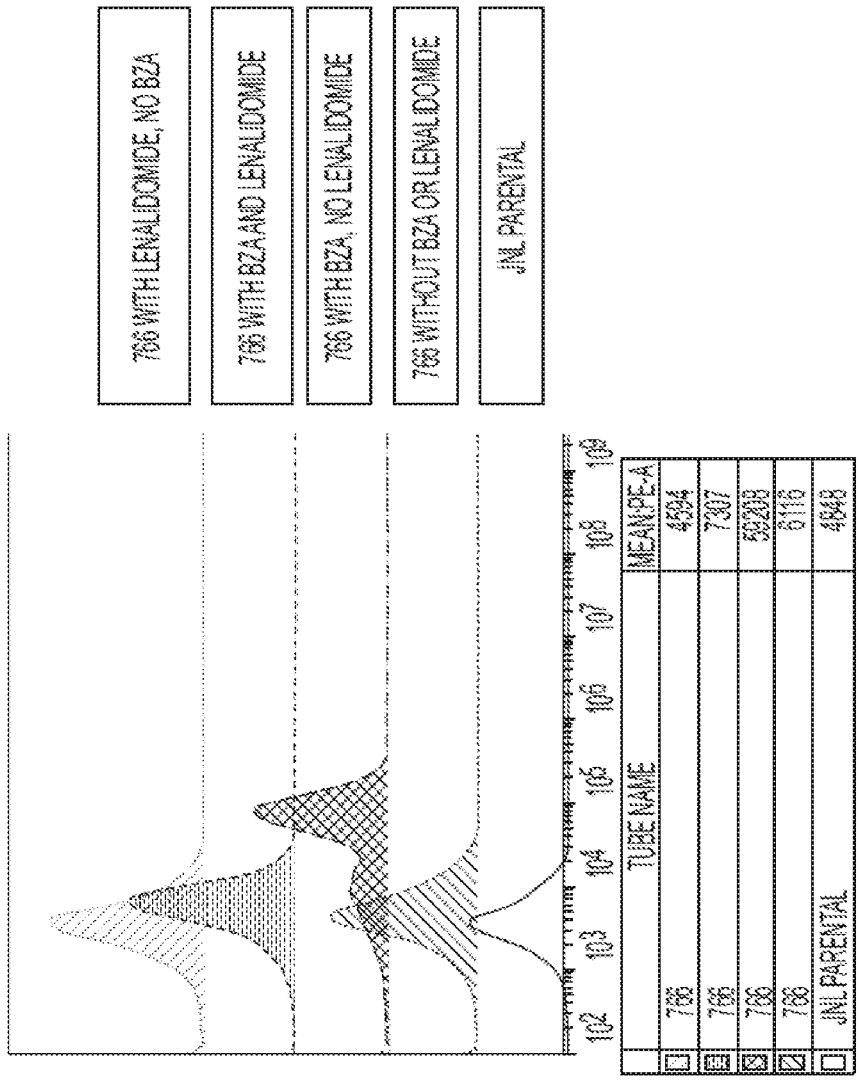

Furthermore, FurON-CAR19 constructs with or without the HilD tag were examined for their surface expression under the regulation of bazedoxifene and/or lenalidomide. As shown in FIGS. 17A, 17B, and 17C, surface CAR expression was only detected in the presence of bazedoxifene and lenalidomide-dependent reduction of surface CAR levels was only observed when CAR19 was fused to the HilD tag.

Table 25 provides a summary of the flow cytometry data shown in FIGS. 16A, 16B, 16C, 16D, 16E, 16F, 16G, 17A, 17B, and 17C.

TABLE 25

Summary of flow cytometry data

| Construct # | Construct | CAR Expression | Effect of bazedoxifene | Effect of lenalidomide | % reduction in CAR expression |
|---|---|---|---|---|---|
| 768 | CAR19_16GS_HilD tag_V5 | Yes | N/A | Yes | 88 |
| 769 | CAR19_16GS_HilD tag | Yes | N/A | Yes | 90 |
| 770 | CAR19_16GS_HilD tag_NoK | Yes | N/A | Yes | 83 |
| 771 | CAR19_HilD tag_V5 | Yes | N/A | Yes | 87 |
| 773 | HilD tag_CAR19_modSigPep | Yes | N/A | No | 4 |
| 774 | HilD tag_CAR19 | Yes | N/A | No | 5 |
| 6761 | CAR19_16KGS_HilD tag_V5 | Yes | N/A | Yes | 77 |
| 765 | FurON_CAR19 | Yes | Yes | No | N/A |
| 766 | FurON_CAR19_16GS_HilD tag_V5 | Yes | Yes | Yes | 92 |
| 767 | FurON_CAR19_16GS_HilD tag | Yes | Yes | Yes | 95 |

Next, surface CAR expression in the presence of a dose titration of lenalidomide was examined by flow cytometry. Briefly, JNL cells stably transduced with construct 769 (CAR19_16GS_HilD tag) or construct 770 (CAR19_16GS_HilD tag_NoK) were incubated with 8 different concentrations of lenalidomide (starting at 2 μM for a 4-hour treatment or 1 μM for a 20-hour treatment) to determine the dose response effect. The cells were then analyzed by flow cytometry as described above using biotinylated-protein L (Genscript, M00097) followed by PE conjugated streptavidin (Jackson Lab, 016-110-084).

Figure 18B:
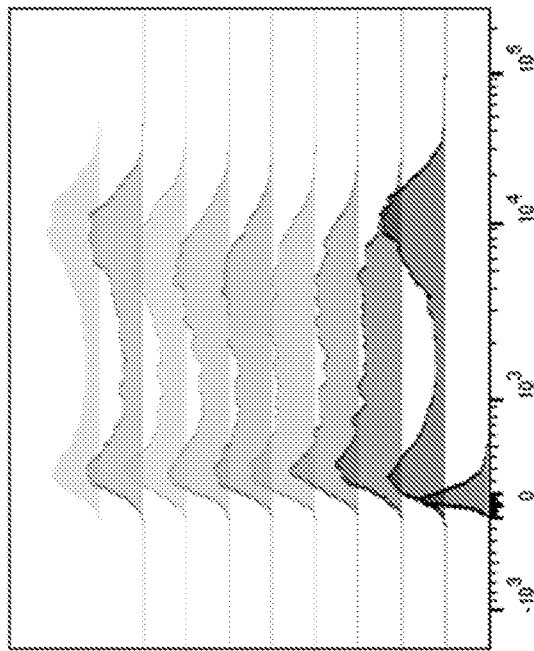
Figure 18C:
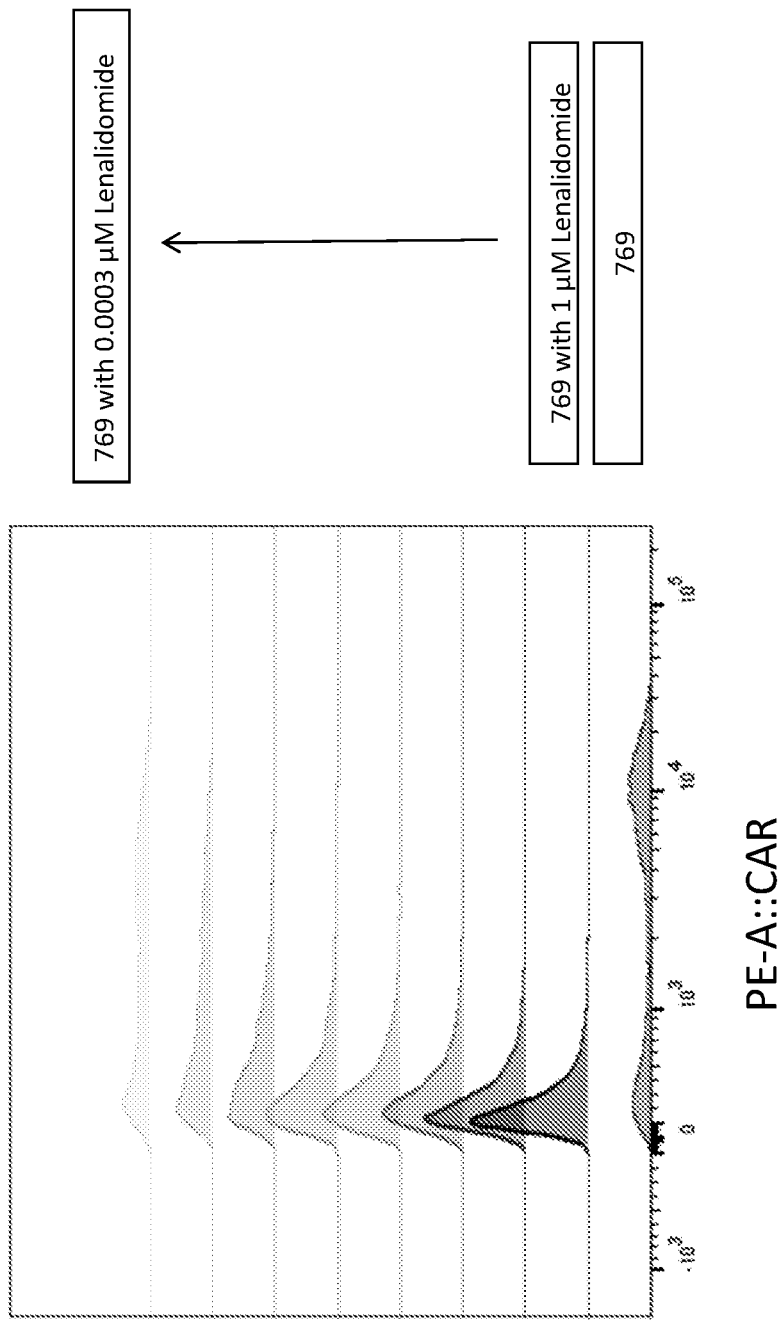
Figure 18D:
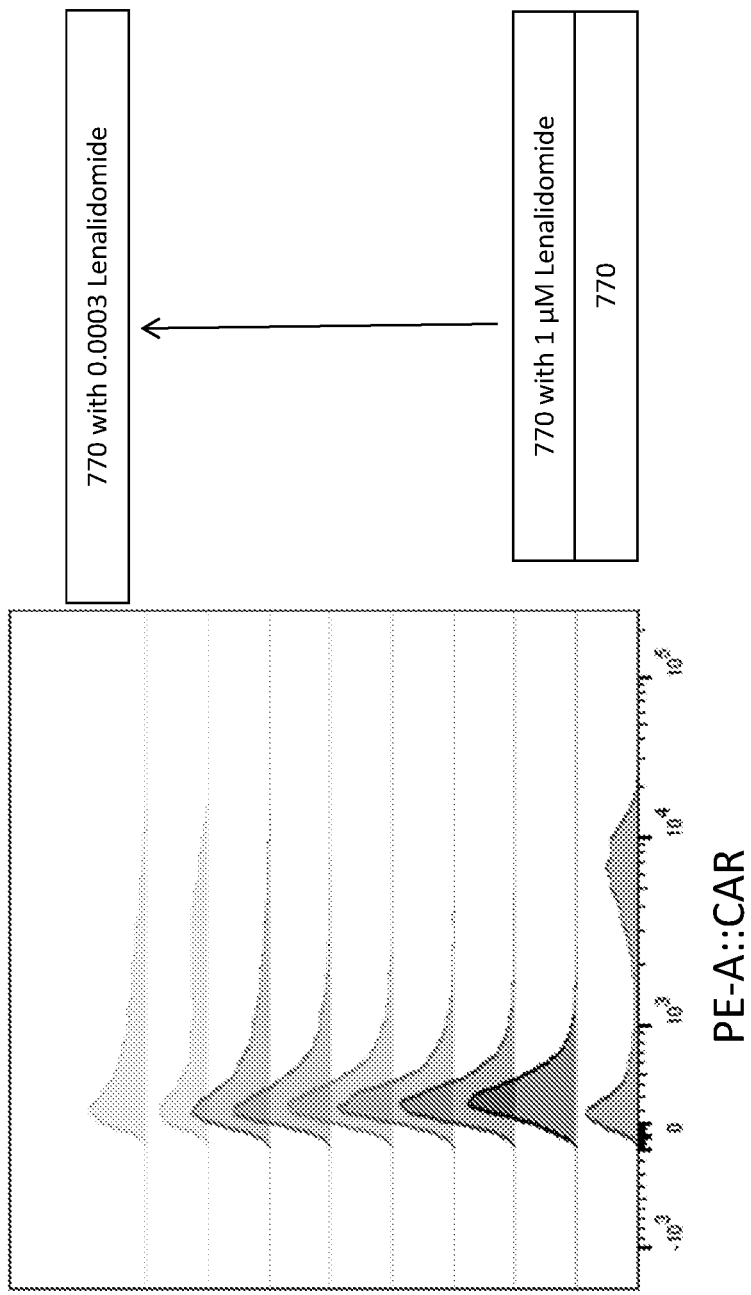
Figure 18E:
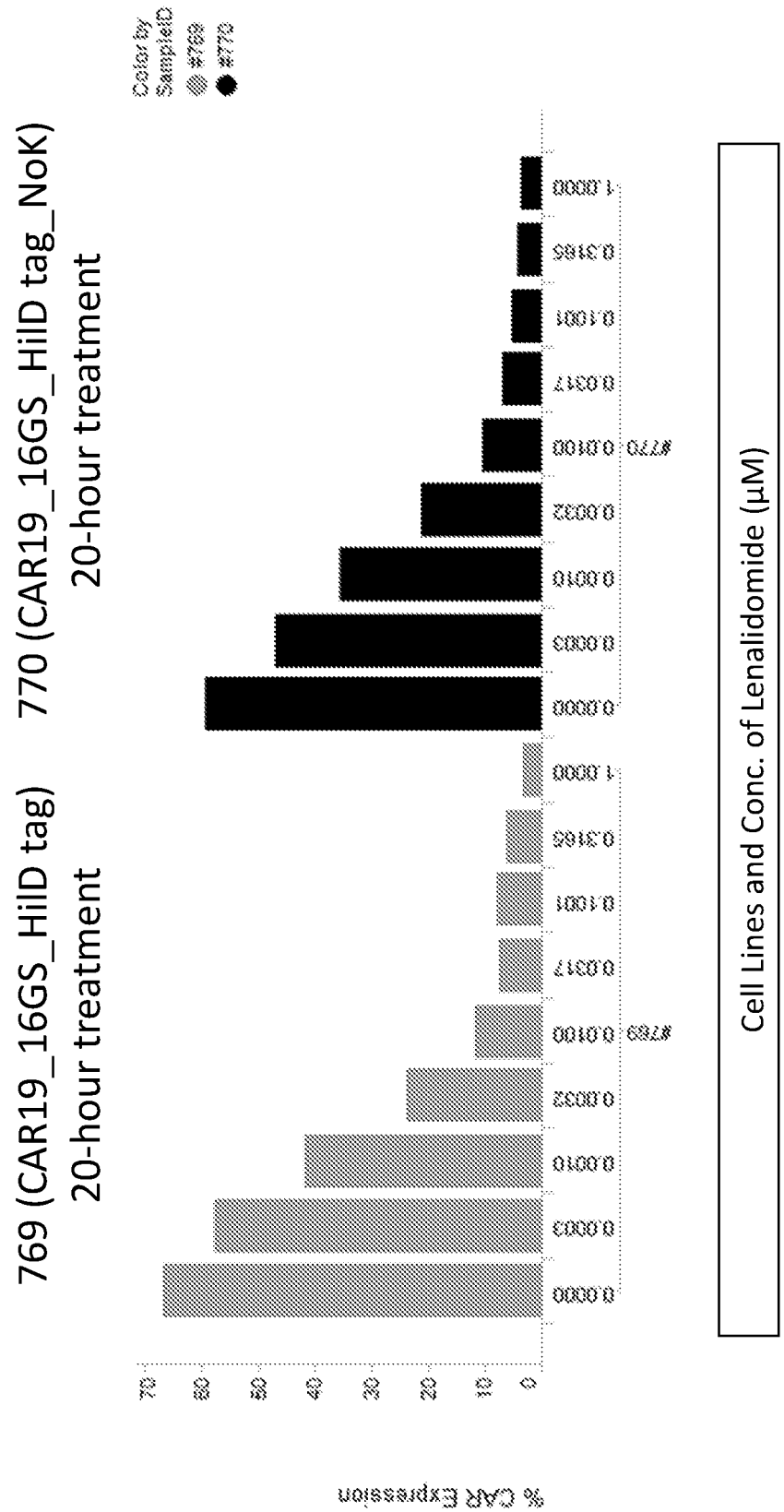
FIGS. 18E and 18F are bar graphs showing % CAR expression (FIG. 18E) or mean fluorescence intensity (FIG. 18F) for each cell line and each lenalidomide concentration tested.
Figure 18F:
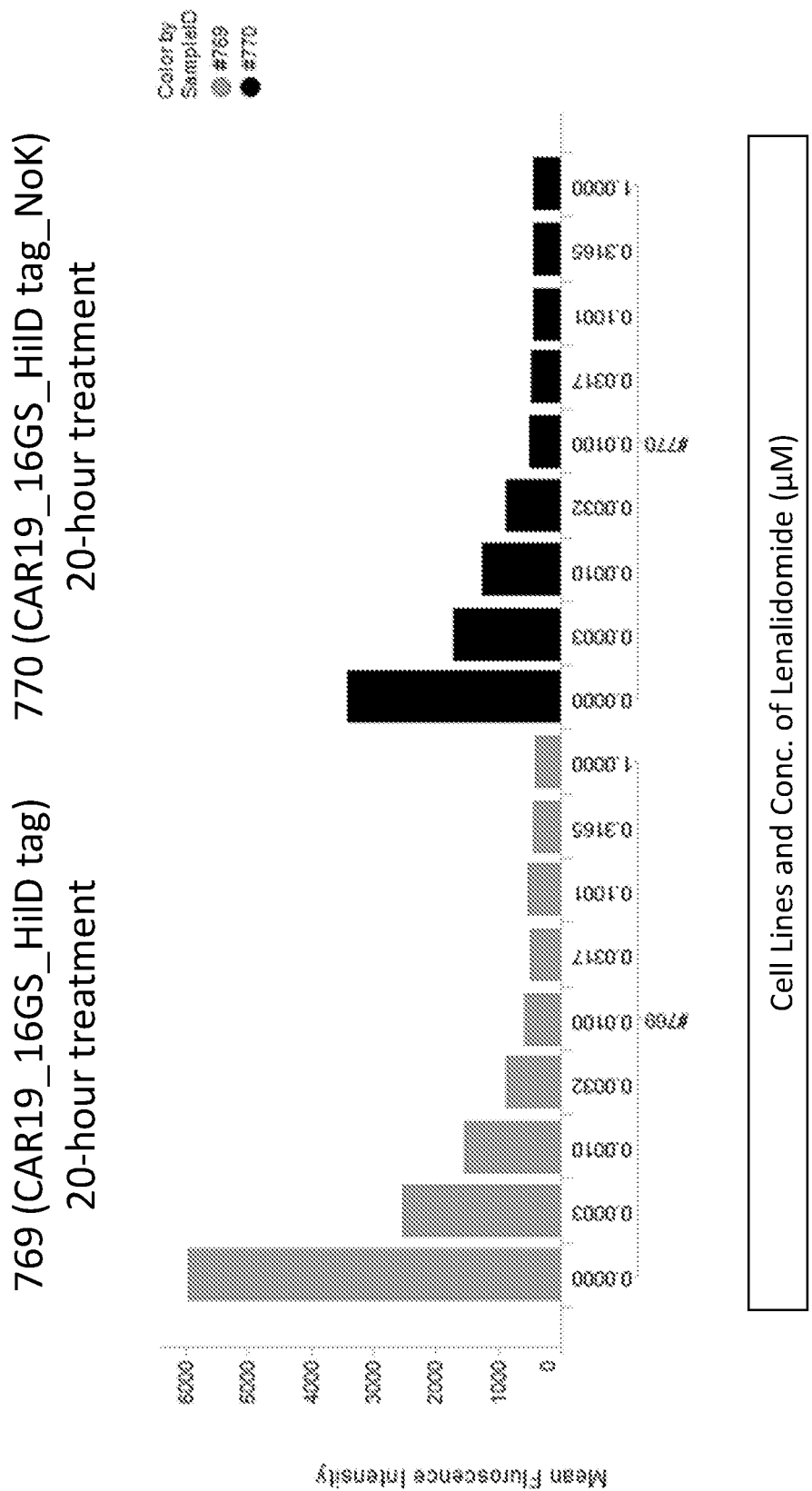

The results for the 4-hour treatment groups are shown in FIGS. 18A and 18B and Table 26. The results for the 20-hour treatment groups are shown in FIGS. 18C, 18D, 18E, and 18F and Table 27. After a 4-hour lenalidomide treatment, a decrease in the MFI was detected with a slight reduction in % CAR expression (% of cells expressing CAR) (Table 26). After a 20-hour treatment, lenalidomide more prominently reduced % CAR expression and MFI in a dose-dependent manner (Table 27, FIGS. 18E and 18F). There was no significant difference between the results from construct 769 (CAR19_16GS_HilD tag) and the results from construct 770 (CAR19_16GS_HilD tag_NoK), suggesting that ubiquitination may mostly occur via the lysine residues in the target protein, rather than in the HilD tag itself.

Figure 19A:
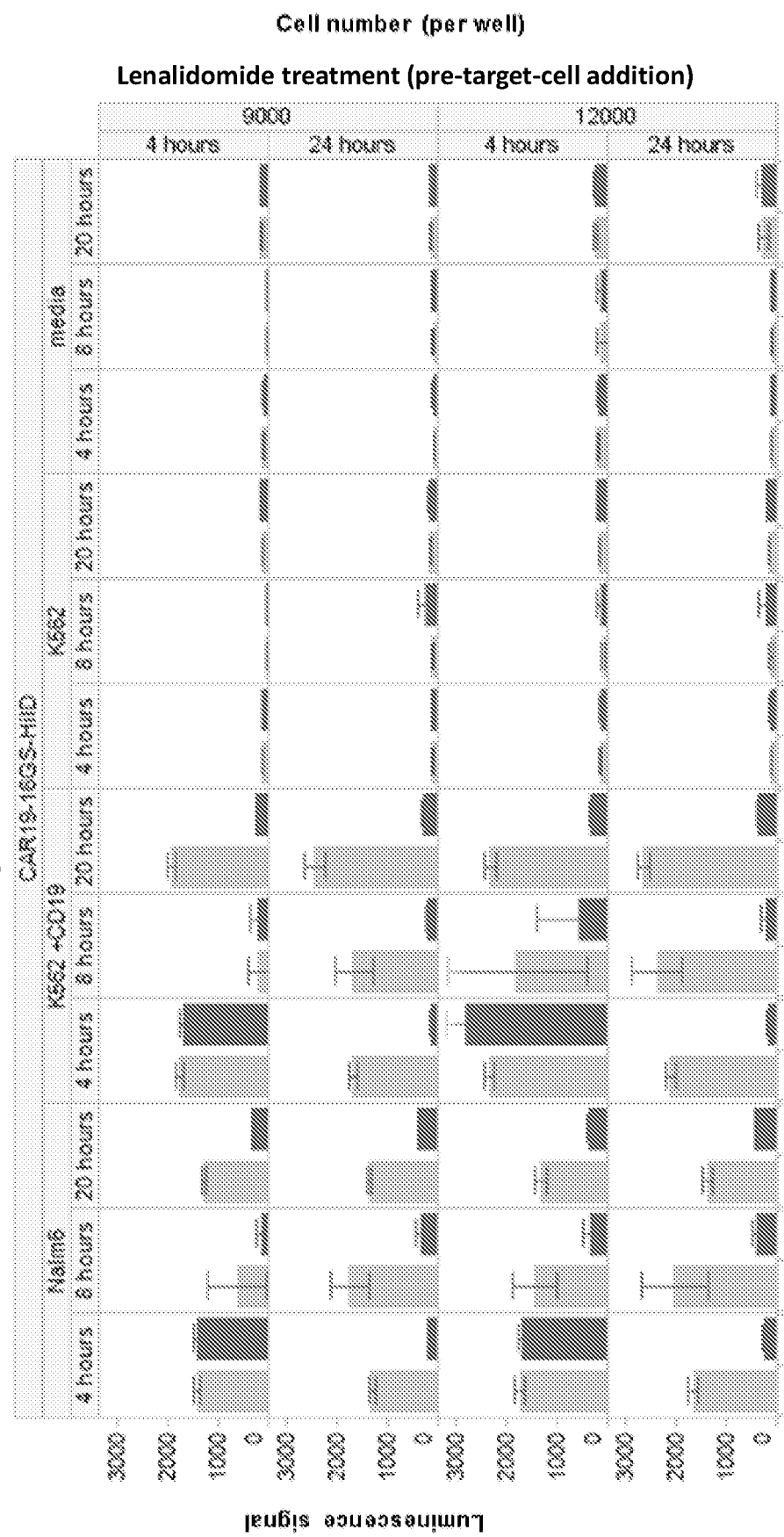
FIGS. 19A and 19B are a series of bar graphs showing lenalidomide response comparisons between JNL target cell line treatment conditions, length of time of target cell line treatment, time of lenalidomide treatment, and number of cells.
Figure 19B:
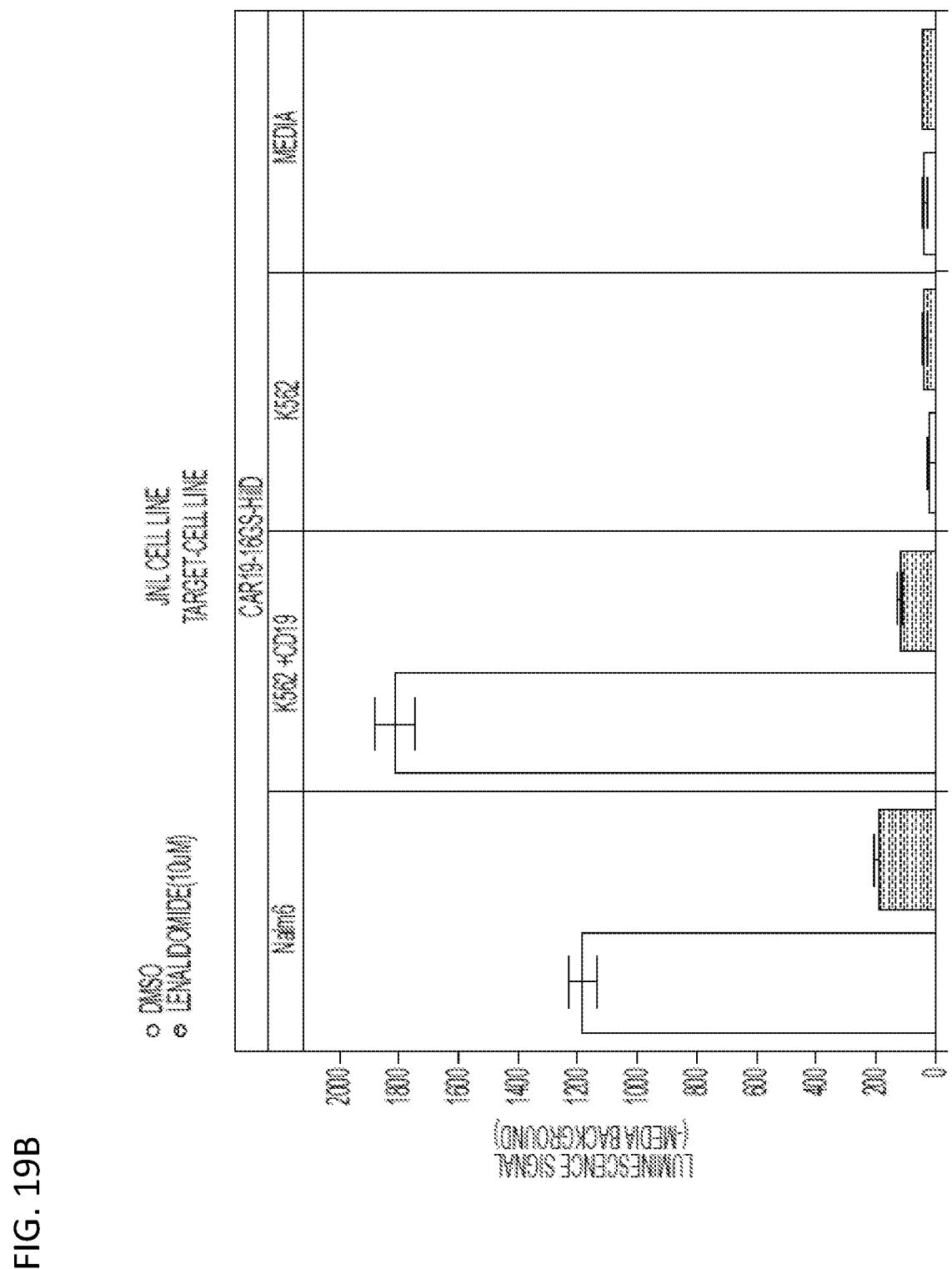

As expected, luminescence signals were only observed when JNL cells expressing construct 769 (CAR19_16GS_HilD tag) were co-cultured with CD19+ target cells (Nalm6 cells and CD19-expressing K562 cells) (FIG. 19A). Lenalidomide treatment reduced the luminescence signal to background levels in every instance with the exception of the 4-hour lenalidomide/4-hour target cell

TABLE 26

Effect of lenalidomide after 4 hours of treatment

| Lenalidomide concentration (μM) | Construct 769 | | Construct 770 | |
|---|---|---|---|---|
| | % CAR Expression | MFI | % CAR Expression | MFI |
| 2 | 59.5 | 2446 | 50.8 | 1576 |
| 0.633 | 60.5 | 2428 | 51.9 | 1577 |
| 0.2 | 61 | 2464 | 51.9 | 1700 |
| 0.063 | 64.6 | 2743 | 56.7 | 1945 |
| 0.02 | 66.1 | 3117 | 58 | 2124 |
| 0.006 | 67 | 3591 | 63.6 | 2763 |
| 0.002 | 67.1 | 4297 | 51.2 | 2255 |
| 0.001 | 68.8 | 4980 | 52 | 2224 |
| 0 | 66.8 | 5975 | 59.4 | 3398 |

TABLE 27

Effect of lenalidomide after 20 hours of treatment

| Lenalidomide concentration (μM) | Construct 769 | | Construct 770 | |
|---|---|---|---|---|
| | % CAR Expression | MFI | % CAR Expression | MFI |
| 1 | 3.42 | 414 | 3.44 | 429 |
| 0.3165 | 6.07 | 447 | 4.3 | 425 |
| 0.1001 | 7.79 | 533 | 5.21 | 425 |
| 0.0317 | 7.49 | 501 | 6.83 | 477 |
| 0.01 | 11.7 | 592 | 10.3 | 502 |
| 0.0032 | 23.8 | 873 | 21.2 | 885 |
| 0.001 | 41.7 | 1552 | 35.4 | 1246 |
| 0.0003 | 57.7 | 2542 | 46.8 | 1731 |
| 0 | 66.8 | 5975 | 59.4 | 3398 |

Example 9: Evaluation of Chimeric Antigen Receptors (CARs) Fused to HilD Tag and/or FurON Using Functional Readout In this example, a number of studies were conducted to determine if CAR19 and FurON-CAR19 were functional when tagged with HilD and whether degradation induced by lenalidomide was sufficient to abolish the function of CAR19 in Jurkat cells.

This study used the JNL cell line described above, which is a Jurkat cell line modified with an NFAT luciferase reporter. Co-culturing of CAR19-expressing JNL cells and CD19-expressing B cells activates the NFAT signaling, leading to luciferase expression.

In a first study, JNL cells expressing construct 767 (FurON_CAR19_16GS_HilD tag) or construct 769 (CAR19_16GS_HilD tag) were plated. JNL cells expressing construct 767 (FurON_CAR19_16GS_HilD tag) were incubated with 1 μM bazedoxifene. All the JNL cells were treated with 10 μM lenalidomide for 4 hours or 24 hours. Lenalidomide-treated JNL cells were incubated with Nalm6 cells, K562 cells, or CD19-expressing K562 cells for 4 hours, 8 hours, or 20 hours. Samples were treated with Brightglo (Promega E2620) following the manufacturer's protocol and luminescence was read in a Perkin Elmer Viewlux with a 5-second or 40-second exposure.

treatments (FIG. 19A). One possible explanation is that JNL cells expressing construct 769 (CAR19_16GS_HilD tag) had to be treated with lenalidomide for longer than 8 hours in order to reduce luminescence signal in this NFAT luciferase reporter assay. After subtracting background signals (signals from the media sample), lenalidomide treatment reduced the luminescence signal by ~95% in CAR-expressing JNL cells co-cultured with CD19-expressing K562 cells and by ~88% in CAR-expressing JNL cells co-cultured with Nalm6 cells. This data suggests that HilD-tag is sufficient to significantly reduce CAR19 function in the presence of lenalidomide.

Figure 20A:
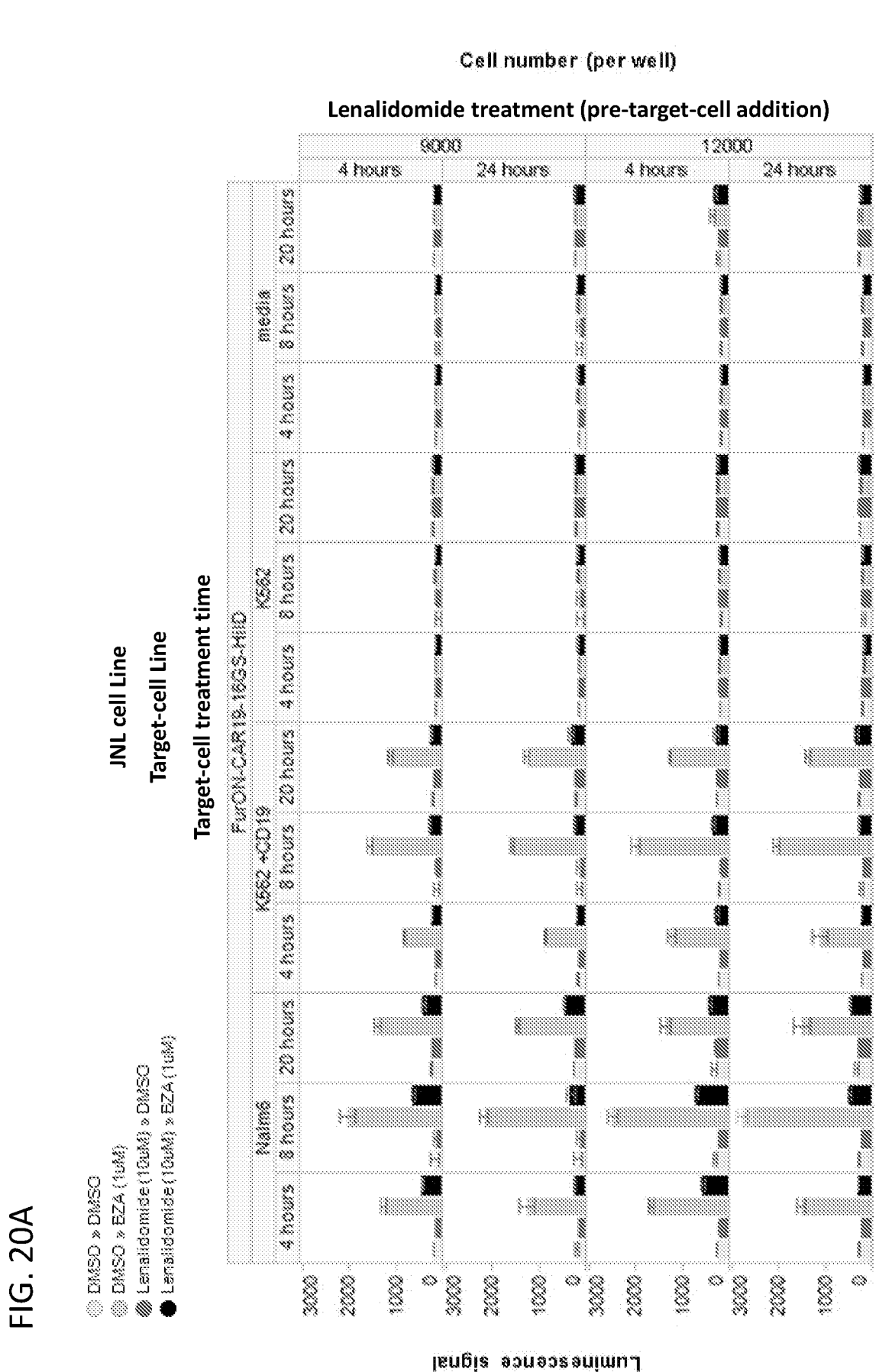
FIGS. 20A and 20B are a series of bar graphs showing lenalidomide response comparisons between JNL target cell treatment conditions, length of time of target cell treatment, time of lenalidomide treatment, and number of cells.
Figure 20B:
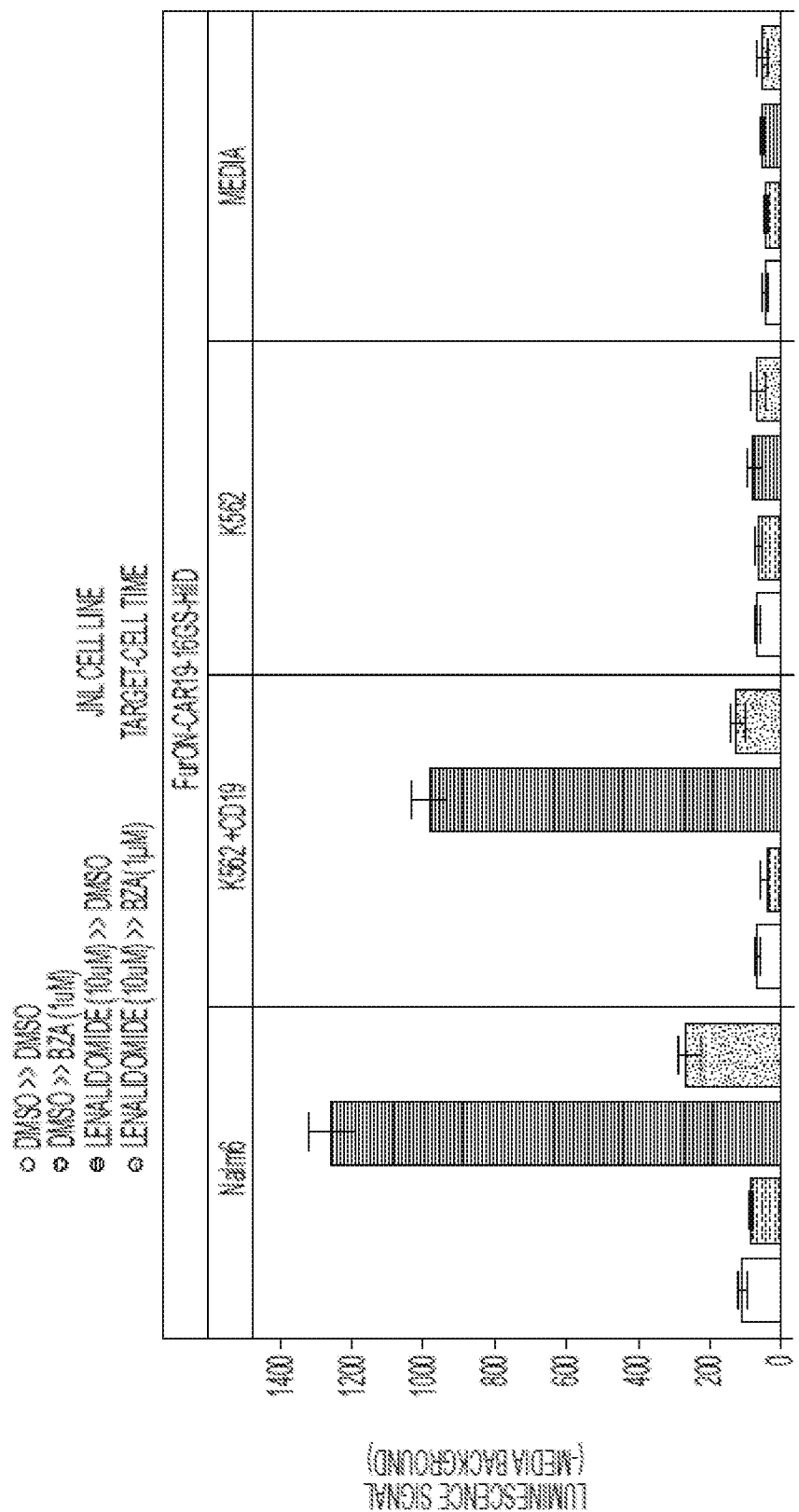

Similarly, luminescence signals were only observed when JNL cells expressing construct 767 (FurON_CAR19_16GS_HilD tag) were co-cultured with CD19+ cells (Nalm6 cells and CD19-expressing K562 cells) in the presence of bazedoxifene (FIG. 20A). Lenalidomide treatment reduced the luminescence signal to background levels in the bazedoxifene co-treated samples (FIG. 20A). After subtracting background signals (signals from the media sample), lenalidomide treatment reduced the luminescence signal by ~90% in CAR-expressing JNL cells co-cultured with CD19-expressing K562 cells and by ~83% in CAR-expressing JNL cells co-cultured with Nalm6 cells (FIG. 20B). This data suggested that for a CAR19 construct modified by both FurON and the HilD tag, the function of the CAR19 can be increased by bazedoxifene treatment and then reduced by lenalidomide treatment.

A second study was conducted to determine the sensitivity of HilD-tagged CAR19 or FurON-CAR19 to lenalidomide-dependent degradation. JNL cells expressing construct 765 (FurON_CAR19), construct 767 (FurON_CAR19_16GS_HilD tag), construct 769 (CAR19_16GS_HilD tag), or construct 770 (CAR19_16GS_HilD tag_NoK) were plated. JNL cells expressing construct 765 (FurON_CAR19) or construct 767 (FurON_CAR19_16GS_HilD tag) were incubated with 1 µM bazedoxifene. There were three treatment groups: "20 hr pre-target cells" (a total of 44-hour lenalidomide treatment), "4 hr pre-target cells" (a total of 28-hour lenalidomide treatment), and "16 hr post-target cells" (a total of 8-hour lenalidomide treatment). For the "20 hr pre-target cells" group, MG132 (10 µM final concentration) was added to transduced JNL cells three hours after bazedoxifene was added, lenalidomide was added 1 hour after MG132 was added, and K562 cells or CD19-expressing K562 target cells were added 20 hours after lenalidomide was added. For the "4 hr pre-target cells" group, MG132 (10 µM final concentration) was added to transduced JNL cells 19 hours after bazedoxifene was added, lenalidomide was added 1 hour after MG132 was added, and K562 cells or CD19-expressing K562 target cells were added 4 hours after lenalidomide was added. For the "16 hr post-target cells" group, K562 cells or CD19-expressing K562 target cells were added to transduced JNL cells 24 hours after bazadoxifene was added, MG132 (10 µM final concentration) was added 15 hours after the target cells were added, and lenalidomide was added 1 hour after MG132 was added. For target cell co-culture, K562 cells or CD19-expressing K562 cells were added to each well containing JNL cells and cultured on a GNF Systems Ultra-high throughput screening system in a 37° C. and 5% $CO_2$ incubator. 24 hours after K562 cells or CD19-expressing K562 cells were added, samples were treated with Brightglo (Promega E2620) following the manufacturer's protocol and luminescence was read in a Perkin Elmer Viewlux with a 5-second exposure.

Figure 21A:
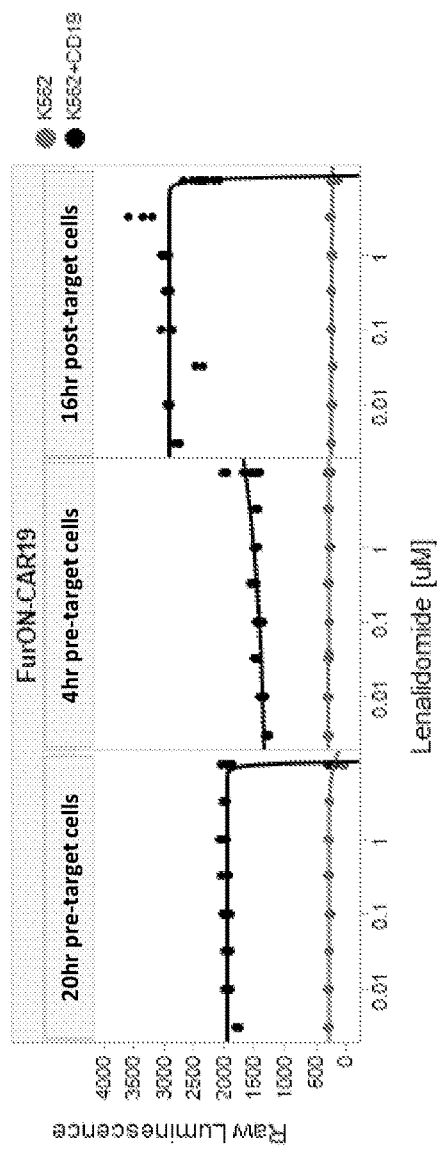
FIGS. 21A, 21B, 21C, and 21D are graphs showing a dose-response effect of lenalidomide on an NFAT luciferase reporter across three treatment time points. JNL cells expressing construct 765 (FurON_CAR19) (FIG. 21A), construct 767 (FurON_CAR19_16GS_HilD tag) (FIG. 21B), construct 769 (CAR19_16GS_HilD tag) (FIG. 21C), or construct 770 (CAR19_16GS_HilD tag_NoK) (FIG. 21D) were incubated with K562 target cells ("K562") or K562 target cells expressing CD19 ("K562+CD19"). Lenalidomide was added 20 hours prior to adding the target cells (a 44-hour lenalidomide treatment, "20 hr pre-target cells"), 4 hours prior to adding target cells (a 28-hour lenalidomide treatment, "4 hr pre-target cells"), or 16 hours after adding target cells (an 8-hour lenalidomide treatment, "16 hr post-target cells"). JNL cells expressing construct 765 (FurON_CAR19) (FIG. 21A) or construct 767 (FurON_CAR19_16GS_HilD tag) (FIG. 21B) were also treated with bazedoxifene. In each graph, raw luminescence is plotted against the indicated lenalidomide concentration.
Figure 21B:
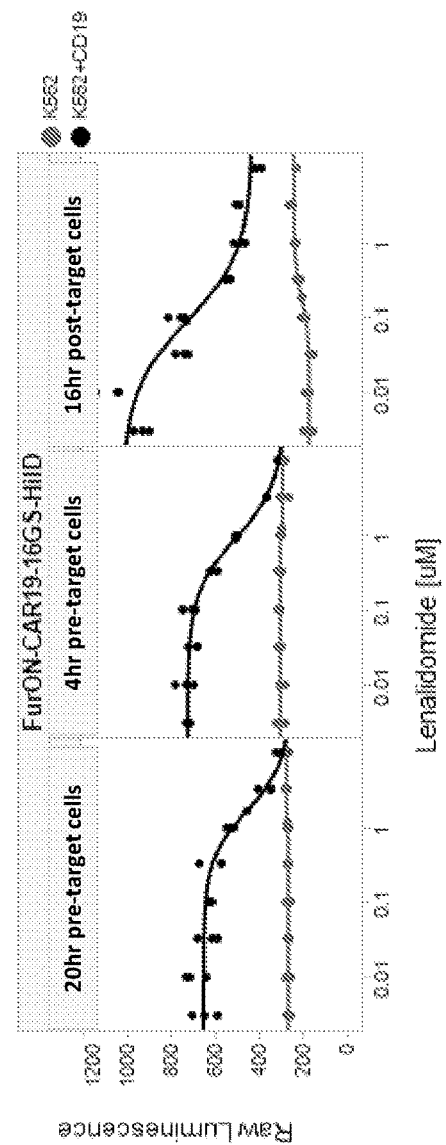
Figure 21C:
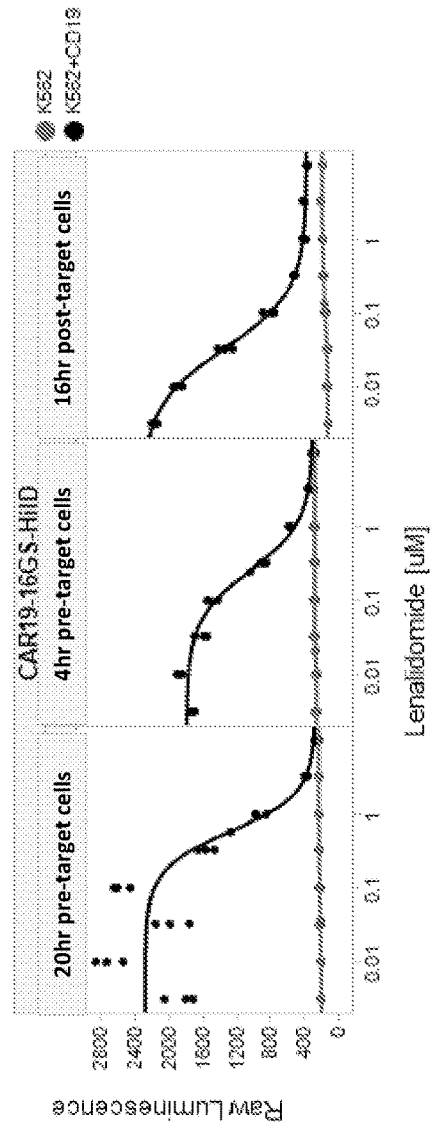
Figure 21D:
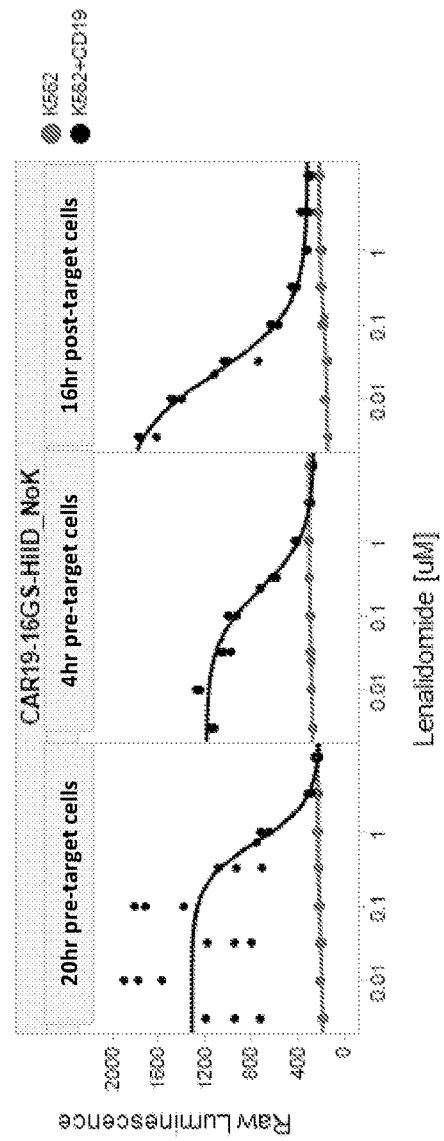

As expected, transduced JNL cells only responded to K562 cells expressing CD19, but not K562 cells (FIGS. 21A, 21B, 21C, and 21D). Without the HilD tag, lenalidomide treatment had no impact on reporter response (FIG. 21A). In the presence of bazedoxifene, JNL cells expressing construct 767 (FurON_CAR19_16GS_HilD tag) showed reporter activation after being co-cultured with CD19-expressing K562 cells and this reporter activation was inhibited by lenalidomide in a dose-dependent manner (FIG. 21B). The IC50s range from ~5 µM-0.1 µM. The IC50s of lenalidomide shift to decreased potency over time, with the highest IC50 at 8-hour treatment ("16 hr post-target cells" in FIG. 21B) and the lowest IC50 at 44-hour treatment ("20 hr pre-target cells" in FIG. 21B). The highest doses of lenalidomide decreased the luminescence signal by 100% in the 44-hour treatment group ("20 hr pre-target cells" in FIG. 21B) and the 28-hour treatment group ("4 hr pre-b-cell" in FIG. 21B), and by 90% in the 8-hour treatment group ("16 hr post-target cells" in FIG. 21B). Lenalidomide also inhibited the NFAT-luciferase reporter activation in JNL cells expressing construct 769 (CAR19_16GS_HilD tag) in a dose-dependent manner (FIG. 21C). The IC50s range from 1 µM to 0.05 µM, with the IC50s decreasing with increased lenalidomide treatment time. The highest 2-3 doses of lenalidomide (10 µM, 3.16 µM, and 1 µM) reduced the luminescence signal by almost 100% (FIG. 21C). Similarly, lenalidomide dose-dependently inhibited reporter activation in JNL cells expressing construct 770 (CAR19_16GS_HilD tag_NoK) (FIG. 21D). The IC50s range from 1 µM to 0.05 µM, with the IC50s decreasing with increased lenalidomide treatment time. The highest 2-3 doses of lenalidomide (10 µM, 3.16 µM, and 1 µM) reduced the signal almost by 100% (FIG. 21D). This response seen for CAR19 fused to the lysine-free HilD tag was similar to the response observed for CAR19 fused to the wild-type HilD tag, suggesting that the degradation of CAR19 is mostly due to ubiquitination of lysine residues on CAR19, rather than lysine residues on the HilD tag.

Figure 22A:
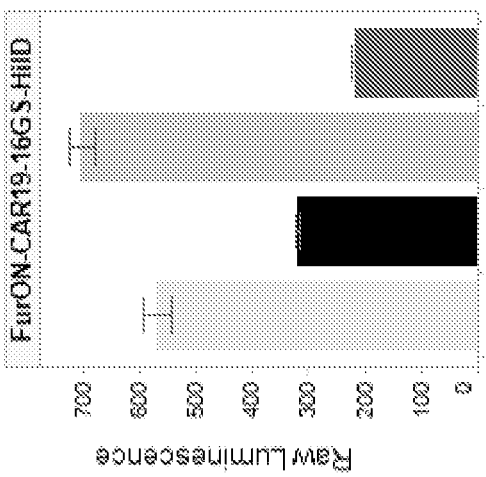
FIGS. 22A, 22B, 22C, and 22D are graphs showing data from the study described in FIGS. 21A, 21B, 21C, and 21D, where JNL cells were treated with MG132 5 hours prior to K562+CD19 target cell treatment, and were treated with lenalidomide 4 hours prior to K562+CD19 target cell treatment. The cells tested include: JNL cells expressing construct 765 (FurON_CAR19) (FIG. 22A), construct 767 (FurON_CAR19_16GS_HilD tag) (FIG. 22B), construct 769 (CAR19_16GS_HilD tag) (FIG. 22C), or construct 770 (CAR19_16GS_HilD tag_NoK) (FIG. 22D). The four bars in each graph represent samples treated with bazedoxifene (BZA), MG132, and lenalidomide ("BZA, MG132, Lenalidomide"), samples treated with bazedoxifene (BZA) and lenalidomide ("BZA, Lenalidomide"), samples treated with bazedoxifene (BZA) ("BZA"), and samples treated with DMSO only ("DMSO"), respectively. The y axis in each graph shows raw luminescence.
Figure 22B:
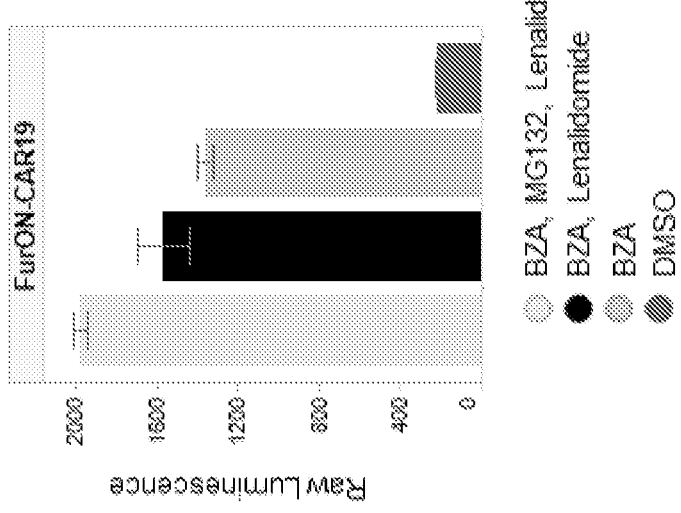
Figures 22C, 22D:
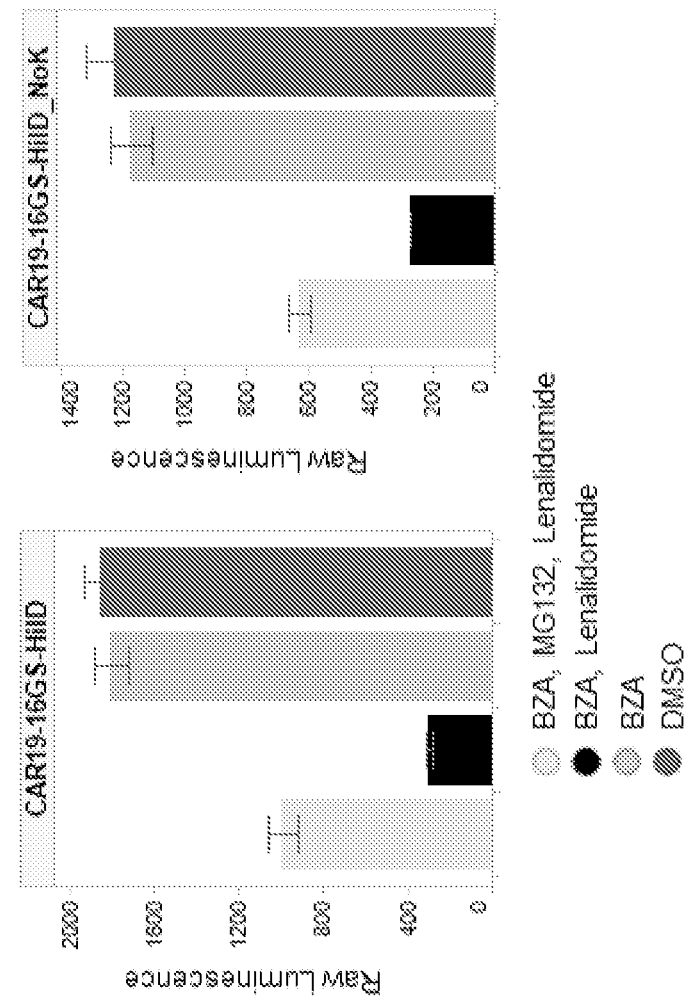

28-hour 10 µM lenalidomide treatment caused reduction in CAR19 expression in all cell lines expressing a HilD-tagged CAR molecule and this reduction can be partially rescued by the proteasome inhibitor MG132 (data not shown). JNL cells expressing different constructs could not be compared directly as they had different levels of CAR expression, resulting in different levels of responses to CD19+ cells. Instead, comparisons were made between treatments in the same cell lines (FIGS. 22A, 22B, 22C, and 22D). For constructs comprising FurON, bazedoxifene treatment was necessary to activate the NFAT-luciferase reporter in the presence of CD19+ cells (FIGS. 22A and 22B). In the absence of the HilD tag, lenalidomide treatment did not impact the luminescence signal and MG132 might increase the signal (FIG. 22A). In the presence of the HilD tag, lenalidomide treatment reduced CD19-induced reporter activation almost to background levels (~80%), and this reduction could be mostly rescued by the proteasome inhibitor MG132 (FIG. 22B). Constructs that do not comprise FurON did not require bazedoxifene for reporter activation (FIGS. 22C and 22D). JNL cells expressing HilD-tagged CAR19 or lysine-free-HilD-tagged CAR19 shared similar responses to lenalidomide: the CD19-induced NFAT reporter signal was significantly reduced by lenalidomide and this reduction could be partially rescued by MG132 (FIGS. 22C and 22D).

Example 10: Evaluation of HilD-Tagged Tau Proteins

Methods
Constructs

Constructs were generated by synthesis of gene blocks (IDT) and introduction into in-house plasmids via Gibson assembly. Table 28 lists the sequences of the constructs used in this example.

TABLE 28

Sequences of the Tau constructs.

| SEQ ID NO | Comment | Sequence |
|---|---|---|
| SEQ ID NO: 35 | Tau 0N4R | MAEPRQEFEVMEDHAGTYGLGDRKDQGGYTMHQDQEGDTDAGL KAEEAGIGDTPSLEDEAAGHVTQARMVSKSKDGTGSDDKKAKGAD GKTKIATPRGAAPPGQKGQANATRIPAKTPPAPKTPPSSGEPPKSGD |

TABLE 28-continued

Sequences of the Tau constructs.

| SEQ ID NO | Comment | Sequence |
|---|---|---|
| | | RSGYSSPGSPGTPGSRSRTPSLPTPPTREPKKVAVVRTPPKSPSSAKS RLQTAPVPMPDLKNVKSKIGSTENLKHQPGGGKVQIINKKLDLSNV QSKCGSKDNIKHVPGGGSVQIVYKPVDLSKVTSKCGSLGNIHHKPG GGQVEVKSEKLDFKDRVQSKIGSLDNITHVPGGGNKKIETHKLTFR ENAKAKTDHGAEIVYKSPVVSGDTSPRHLSNVSSTGSIDMVDSPQL ATLADEVSASLAKQGL |
| SEQ ID NO: 36 | Tau 0N4R P301S | MAEPRQEFEVMEDHAGTYGLGDRKDQGGYTMHQDEGDTDAGL KAEEAGIGDTPSLEDEAAGHVTQARMVSKSKDGTGSDDKKAKGAD GKTKIATPRGAAPPGQKGQANATRIPAKTPPAPKTPPSSGEPPKSGD RSGYSSPGSPGTPGSRSRTPSLPTPPTREPKKVAVVRTPPKSPSSAKS RLQTAPVPMPDLKNVKSKIGSTENLKHQPGGGKVQIINKKLDLSNV QSKCGSKDNIKHVSGGGSVQIVYKPVDLSKVTSKCGSLGNIHHKPG GGQVEVKSEKLDFKDRVQSKIGSLDNITHVPGGGNKKIETHKLTFR ENAKAKTDHGAEIVYKSPVVSGDTSPRHLSNVSSTGSIDMVDSPQL ATLADEVSASLAKQGL |
| SEQ ID NO: 101 | HilD-16xGS-Tau 0N4R | MHKRSHTGERPFQCNQCGASFTQKGNLLRHIKLHTGEKPFKCHLCN TASAEARHIKAEMGGGGGSGGGGTGGGGSGMAEPRQEFEVMEDH AGTYGLGDRKDQGGYTMHQDQEGDTDAGLKAEEAGIGDTPSLED EAAGHVTQARMVSKSKDGTGSDDKKAKGADGKTKIATPRGAAPP GQKGQANATRIPAKTPPAPKTPPSSGEPPKSGDRSGYSSPGSPGTPGS RSRTPSLPTPPTREPKKVAVVRTPPKSPSSAKSRLQTAPVPMPDLKN VKSKIGSTENLKHQPGGGKVQIINKKLDLSNVQSKCGSKDNIKHVP GGGSVQIVYKPVDLSKVTSKCGSLGNIHHKPGGGQVEVKSEKLDFK DRVQSKIGSLDNITHVPGGGNKKIETHKLTFRENAKAKTDHGAEIV YKSPVVSGDTSPRHLSNVSSTGSIDMVDSPQLATLADEVSASLAKQ GL |
| SEQ ID NO: 102 | HilD-16xGS-Tau 0N4R (P301S)-XTEN linker-YFP | MHKRSHTGERPFQCNQCGASFTQKGNLLRHIKLHTGEKPFKCHLCN TASAEARHIKAEMGGGGGSGGGGTGGGGSGMAEPRQEFEVMEDH AGTYGLGDRKDQGGYTMHQDQEGDTDAGLKAEEAGIGDTPSLED EAAGHVTQARMVSKSKDGTGSDDKKAKGADGKTKIATPRGAAPP GQKGQANATRIPAKTPPAPKTPPSSGEPPKSGDRSGYSSPGSPGTPGS RSRTPSLPTPPTREPKKVAVVRTPPKSPSSAKSRLQTAPVPMPDLKN VKSKIGSTENLKHQPGGGKVQIINKKLDLSNVQSKCGSKDNIKHVS GGGSVQIVYKPVDLSKVTSKCGSLGNIHHKPGGGQVEVKSEKLDFK DRVQSKIGSLDNITHVPGGGNKKIETHKLTFRENAKAKTDHGAEIV YKSPVVSGDTSPRHLSNVSSTGSIDMVDSPQLATLADEVSASLAKQ GLGSSSGSETPGTSESATPESVSKGEELFTGVVPILVELDGDVNGHKF SVSGEGEGDATYGKLTLKFICTTGKLPVPWPTLVTTFGYGLQCFAR YPDHMKQHDFFKSAMPEGYVQERTIFFKDDGNYKTRAEVKFEGDT LVNRIELKGIDFKEDGNILGHKLEYNYNSHNVYIMADKQKNGIKVN FKIRHNIEDGSVQLADHYQQNTPIGDGPVLLPDNHYLSYQSALSKDP NEKRDHMVLLEFVTAAGITLGMDELYK |
| SEQ ID NO: 103 | HilD-16xGS-Tau 0N4R-16xGS linker-Biotin ligase | MHKRSHTGERPFQCNQCGASFTQKGNLLRHIKLHTGEKPFKCHLCN TASAEARHIKAEMGGGGGSGGGGTGGGGSGMAEPRQEFEVMEDH AGTYGLGDRKDQGGYTMHQDQEGDTDAGLKAEEAGIGDTPSLED EAAGHVTQARMVSKSKDGTGSDDKKAKGADGKTKIATPRGAAPP GQKGQANATRIPAKTPPAPKTPPSSGEPPKSGDRSGYSSPGSPGTPGS RSRTPSLPTPPTREPKKVAVVRTPPKSPSSAKSRLQTAPVPMPDLKN VKSKIGSTENLKHQPGGGKVQIINKKLDLSNVQSKCGSKDNIKHVP GGGSVQIVYKPVDLSKVTSKCGSLGNIHHKPGGGQVEVKSEKLDFK DRVQSKIGSLDNITHVPGGGNKKIETHKLTFRENAKAKTDHGAEIV YKSPVVSGDTSPRHLSNVSSTGSIDMVDSPQLATLADEVSASLAKQ GLGLGGGGSGGGGTGGGGSGMDFKNLIWLKEVDSTQERLKEWNVSY GTALVADRQTKGRGGLGRKWLSQEGGLYFSFLLNPKEFENLLQLPL VLGLSVSEALEEITEIPFSLKWPNDVYFQEKKVSGVLCELSKDKLIV GIGINVNQREIPEEIKDRATTLYEITGKDWDRKEVLLKVLKRISENLK KPFKEKSFKEFGKIESKMLYLGEEVKLLGEGKITGKLVGLSEKGGA LILTEEGIKEILSGEFSLRRS |
| SEQ ID NO: 104 | HilD-16xGS-Tau 0N4R-16xGS-V5 linker-Biotin ligase | MHKRSHTGERPFQCNQCGASFTQKGNLLRHIKLHTGEKPFKCHLCN TASAEARHIKAEMGGGGGSGGGGTGGGGSGMAEPRQEFEVMEDH AGTYGLGDRKDQGGYTMHQDQEGDTDAGLKAEEAGIGDTPSLED EAAGHVTQARMVSKSKDGTGSDDKKAKGADGKTKIATPRGAAPP GQKGQANATRIPAKTPPAPKTPPSSGEPPKSGDRSGYSSPGSPGTPGS RSRTPSLPTPPTREPKKVAVVRTPPKSPSSAKSRLQTAPVPMPDLKN VKSKIGSTENLKHQPGGGKVQIINKKLDLSNVQSKCGSKDNIKHVP GGGSVQIVYKPVDLSKVTSKCGSLGNIHHKPGGGQVEVKSEKLDFK DRVQSKIGSLDNITHVPGGGNKKIETHKLTFRENAKAKTDHGAEIV YKSPVVSGDTSPRHLSNVSSTGSIDMVDSPQLATLADEVSASLAKQ GLGGGGSGGGGTGGGGSGGKPIPNPLLGLDSTGSGMDFKNLIWLKE VDSTQERLKEWNVSYGTALVADRQTKGRGGLGRKWLSQEGGLYF |

TABLE 28-continued

Sequences of the Tau constructs.

| SEQ ID NO | Comment | Sequence |
|---|---|---|
| | | SFLLNPKEFENLLQLPLVLGLSVSEALEEITEIPFSLKWPNDVYFQEK KVSGVLCELSKDKLIVGIGINVNQREIPEEIKDRATTLYEITGKDWDR KEVLLKVLKRISENLKKFKEKSFKEFKGKIESKMLYLGEEVKLLGEG KITGKLVGLSEKGGALILTEEGIKEILSGEFSLRRS |
| SEQ ID NO: 105 | HilD-16xGS-Tau 0N4R-33xGS-linker-Biotin ligase | MHKRSHTGERPFQCNQCGASFTQKGNLLRHIKLHTGEKPFKCHLCN TASAEARHIKAEMGGGGGSGGGGTGGGGSGMAEPRQEFEVMEDH AGTYGLGDRKDQGGYTMHQDQEGDTDAGLKAEEAGIGDTPSLED EAAGHVTQARMVSKSKDGTGSDDKKAKGADGKTKIATPRGAAPP GQKGQANATRIPAKTPPAPKTPPSSGEPPKSGDRSGYSSPGSPGTPGS RSRTPSLPTPPTREPKKVAVVRTPPKSPSSAKSRLQTAPVPMPDLKN VKSKIGSTENLKHQPGGGKVQIINKKLDLSNVQSKCGSKDNIKHVP GGGSVQIVYKPVDLSKVTSKCGSLGNIHHKPGGGQVEVKSEKLDFK DRVQSKIGSLDNITHVPGGGNKKIETHKLTFRENAKAKTDHGAEIV YKSPVVSGDTSPRHLSNVSSTGSIDMVDSPQLATLADEVSASLAKQ GLGGGGSGGGGTGGGGSGGGGTGGGGSGGGGTGMDFKNLIWL KEVDSTQERLKEWNVSYGTALVADRQTKGRGGLGRKWLSQEGGL YFSFLLNPKEFENLLQLPLVLGLSVSEALEEITEIPFSLKWPNDVYFQ EKKVSGVLCELSKDKLIVGIGINVNQREIPEEIKDRATTLYEITGKDW DRKEVLLKVLKRISENLKKFKEKSFKEFKGKIESKMLYLGEEVKLL GEGKITGKLVGLSEKGGALILTEEGIKEILSGEFSLRRS |
| SEQ ID NO: 106 | HilD-16xGS-Tau 0N4R-XTEN linker-Biotin ligase | MHKRSHTGERPFQCNQCGASFTQKGNLLRHIKLHTGEKPFKCHLCN TASAEARHIKAEMGGGGGSGGGGTGGGGSGMAEPRQEFEVMEDH AGTYGLGDRKDQGGYTMHQDQEGDTDAGLKAEEAGIGDTPSLED EAAGHVTQARMVSKSKDGTGSDDKKAKGADGKTKIATPRGAAPP GQKGQANATRIPAKTPPAPKTPPSSGEPPKSGDRSGYSSPGSPGTPGS RSRTPSLPTPPTREPKKVAVVRTPPKSPSSAKSRLQTAPVPMPDLKN VKSKIGSTENLKHQPGGGKVQIINKKLDLSNVQSKCGSKDNIKHVP GGGSVQIVYKPVDLSKVTSKCGSLGNIHHKPGGGQVEVKSEKLDFK DRVQSKIGSLDNITHVPGGGNKKIETHKLTFRENAKAKTDHGAEIV YKSPVVSGDTSPRHLSNVSSTGSIDMVDSPQLATLADEVSASLAKQ GLSGSETPGTSESATPESMDFKNLIWLKEVDSTQERLKEWNVSYGT ALVADRQTKGRGGLGRKWLSQEGGLYFSFLLNPKEFENLLQLPLVL GLSVSEALEEITEIPFSLKWPNDVYFQEKKVSGVLCELSKDKLIVGIG INVNQREIPEEIKDRATTLYEITGKDWDRKEVLLKVLKRISENLKKF KEKSFKEFKGKIESKMLYLGEEVKLLGEGKITGKLVGLSEKGGALIL TEEGIKEILSGEFSLRRS |
| SEQ ID NO: 107 | Tau 0N4R-16xG5-Biotin ligase | MAEPRQEFEVMEDHAGTYGLGDRKDQGGYTMHQDQEGDTDAGL KAEEAGIGDTPSLEDEAAGHVTQARMVSKSKDGTGSDDKKAKGAD GKTKIATPRGAAPPGQKGQANATRIPAKTPPAPKTPPSSGEPPKSGD RSGYSSPGSPGTPGSRSRTPSLPTPPTREPKKVAVVRTPPKSPSSAKS RLQTAPVPMPDLKNVKSKIGSTENLKHQPGGGKVQIINKKLDLSNV QSKCGSKDNIKHVPGGGSVQIVYKPVDLSKVTSKCGSLGNIHHKPG GGQVEVKSEKLDFKDRVQSKIGSLDNITHVPGGGNKKIETHKLTFR ENAKAKTDHGAEIVYKSPVVSGDTSPRHLSNVSSTGSIDMVDSPQL ATLADEVSASLAKQGLGGGGSGGGGTGGGGSGMDFKNLIWLKEV DSTQERLKEWNVSYGTALVADRQTKGRGGLGRKWLSQEGGLYFSF LLNPKEFENLLQLPLVLGLSVSEALEEITEIPFSLKWPNDVYFQEKKV SGVLCELSKDKLIVGIGINVNQREIPEEIKDRATTLYEITGKDWDRKE VLLKVLKRISENLKKFKEKSFKEFKGKIESKMLYLGEEVKLLGEGKI TGKLVGLSEKGGALILTEEGIKEILSGEFSLRRS |
| SEQ ID NO: 108 | Tau 0N4R-16xG5-V5-Biotin ligase | MAEPRQEFEVMEDHAGTYGLGDRKDQGGYTMHQDQEGDTDAGL KAEEAGIGDTPSLEDEAAGHVTQARMVSKSKDGTGSDDKKAKGAD GKTKIATPRGAAPPGQKGQANATRIPAKTPPAPKTPPSSGEPPKSGD RSGYSSPGSPGTPGSRSRTPSLPTPPTREPKKVAVVRTPPKSPSSAKS RLQTAPVPMPDLKNVKSKIGSTENLKHQPGGGKVQIINKKLDLSNV QSKCGSKDNIKHVPGGGSVQIVYKPVDLSKVTSKCGSLGNIHHKPG GGQVEVKSEKLDFKDRVQSKIGSLDNITHVPGGGNKKIETHKLTFR ENAKAKTDHGAEIVYKSPVVSGDTSPRHLSNVSSTGSIDMVDSPQL ATLADEVSASLAKQGLGGGGSGGGGTGGGGSGGKPIPNPLLGLDST GSGMDFKNLIWLKEVDSTQERLKEWNVSYGTALVADRQTKGRGG LGRKWLSQEGGLYFSFLLNPKEFENLLQLPLVLGLSVSEALEEITEIP FSLKWPNDVYFQEKKVSGVLCELSKDKLIVGIGINVNQREIPEEIKD RATTLYEITGKDWDRKEVLLKVLKRISENLKKFKEKSFKEFKGKIES KMLYLGEEVKLLGEGKITGKLVGLSEKGGALILTEEGIKEILSGEFSL RRS |

Biotin Ligase Transfection and Biotin Immunoprecipitation

HEK293T cells grown in 6-well tissue culture dishes were transfected with 3 micrograms of FLAG tagged CRBN and 2.1 micrograms of indicated Tau fusion construct using 6 μL of lipofectamine 2000, in a final volume of 200 μL of Optimem media. 48 hours after transfection, cells were treated with 50 μM biotin (diluted from 100 mM stock prepared in DMSO) and either DMSO (1 to 10,000) or 1 micromolar lenalidomide. Cells were incubated for 21 hours, then lysed after a wash in ice-cold PBS with 300 μL ice cold M-PER buffer (Thermo Fisher #78501) containing 1× Halt protease inhibitors (Thermo Fisher #1861281). Cell lysate was cleared and protein quantified by the BCA reaction, and protein concentration normalized in M-PER buffer. 20% of cell lysate (60 μL) was diluted 4-fold in an IP-lysis buffer (15 mM Tris pH7.5, 120 mM NaCl, 25 mM KCl, 2 mM EGTA, 2 mM EDTA, 0.5% Triton X-100, 1× Halt protease inhibitor) and incubated with 50 μL Streptavidin M-280 magnetic Dynabeads (Thermo Fisher Cat #11205D) for 30 minutes at room temperature. Beads were subsequently washed three times with IP lysis buffer, then finally dissolved in 20 μL M-PER buffer containing protease inhibitors. 4× NuPage LDS buffer was added to a final concentration of 1× in this immunoprecipitated material and cell lysates were similarly diluted. 10× NuPage reducing buffer was then added to a concentration of 1×, and samples were heated to 95° C. for 5 minutes. Cell lysate or immunoprecipitated material were run on a 10% Bis-Tris Criterion XT gel (BioRad 3450111), blotted (TurboBlot), and incubated with primary antibodies as indicated. LiCor RDye 800CW Goat anti-rabbit (#925-32211) or 680 RD (#925-68070) secondary antibodies were incubated and signal measured on an Li-Cor Odyssey CLx imaging station.

Image Analysis of HilD-Tau-YFP Fusions in HEK293T Cells

One day prior to transfection, wild-type HEK 293T or CRBN knockout (KO) HEK293T cells were seeded at 22.5K cells per well in 96-well plates. Cells were then transfected with 0.02 micrograms of HilD-Tau (P301S) fusion construct. One day after transfection wells were treated with varying concentrations of lenalidomide. After an overnight treatment cells were fixed in a final solution of 4% PFA and 4% Sucrose for 15 minutes. Fixed cells were washed with PBS. Cells were then incubated with 1:5000 Hoechst and 1:10000 Cellmask HCS for fifteen minutes, washed, then imaged.

Plates were imaged on the Incell Analyzer 6000 using a 20× objective capture and DAPI, FITC, and Cy5 channels. Image data was then quantified using cellprofiler where the cell nucleus was segmented via Hoechst staining and then the cell body identified by expanding the nuclear object to the edges of the segmented cell, identified by Cell mask staining. This cellular object was then used to measure the FITC intensity, corresponding to HilD-Tau (P301S)-YFP.

HEK293T Transfection and Quantification of HilD-Tau Degradation by Western Analysis One day prior to transfection, HEK293T cells were plated at a density of 150,000 per well in a 24 well plate. The cells were then transfected with 0.175 micrograms of HilD-Tau (wild type). Four hours or 24 hours after transfection, wells were treated with a dose response of Lenalidomide. Cells were incubated overnight. The cells were then washed with ice cold PBS and lysed in 85 μL of N-PER buffer (Thermo Fisher #87792) supplemented with Halt protease and phosphatase inhibitors. Plates were incubated on ice with occasional shaking for 15 minutes. Lysate was then cleared by centrifugation at 15000 g, 4° C. for 15 minutes. LDS buffer and reducing agent were added to the cleared lysate and then samples were heated at 95° C. for 8 minutes. Samples were run on a 10% bis-tris gel at 150V for 70 minutes. Blots were transferred using the Biorad turboblot (Mixed molecular weight setting). Blots were probed with DAKO Tau (total tau) (Dako #A0024), actin (Cell signaling technologies #3700S), and AT8 (phospho-Tau) (Thermo Fisher #MN1020). The blots were developed with Supersignal west femto chemiluminescent substrate (Thermo Fisher #34095).

Quantification of Western bands was according to Molecular Psychiatry (2017) 22, 417-429.

Rat Neuron Dissection and Nucleofection

Rat cortices were isolated from embryonic day 18.5 rats. Single cell suspensions were prepared by 15 minutes 37° C. digestion in papain (Brainbits #PAP) diluted in 3 mL of Hibernate E (—Ca) solution (Brainbits #HECA); next supplemented with DNAse (to a concentration of 0.5 mg/mL); triturated; incubated 10 minutes at 37° C.; triturated; and finally filtered through a 40 μm cell strainer. Approximately 8 million cells were nucleofected using P3 solution (Lonza nucleofection kit #V4XP-1024) with 2 micrograms of indicated plasmids. Program CU-133 on the 4D nucleofector was used. Cells were then diluted in neurobasal media (Life Technologies #21103) containing 1% serum, and plated at a density of 80,000 cells per well of a 96-well Biocoat (Corning #356640) plate. Note that substantial cell death occurred after nucleofection, necessitating the high initial plating density. On the subsequent day, the media was completely exchanged for media lacking serum.

Media was 50% exchanged every 7 days. On day 9, compounds were added to media at indicated final concentrations. Imaging of YFP signal was conducted at indicated intervals using InCell 6000 system (General Electric), coupled to a Liconic Instruments IC incubator (Cat 391180700)/plate hotel via a Thermo Scientific Orbitor RS robot.

Human Neuron Nucleofection

Human pluripotent stem cells (hPSCs) were maintained in E8 media (Stem Cell Technologies) on vitronectin coated tissue culture plates. Confluent monolayers of hPSCs were neurally converted by changing the media to Ph I (see below for media recipes). Seven days post induction, cells were dissociated to single-cell suspension with Accutase, seeded at 1.5 million cells per milliliter in spinner flasks with Ph II/III media supplemented with 2 micromolar Thiazovivin and 10 ng/mL FGF2 (final) and incubated at 37° C. on a micro-stir plate at 40 rpm for 4 days. Media was then changed to Ph II/III and neurospheres were further cultured for 17 days at 60 rpm, changing media 50% twice a week. On day 28 media was changed to Ph IV and cultures were maintained 21 more days with 50% media change twice a week. From day 49 onwards cultures were switched to Ph V media for maintenance and dissociated with Papain kit (Worthington Sciences) for neuronal platedowns on laminin, fibronectin, and matrigel coated plates. Single cell suspension was nucleofected (10 million cells per reaction), 2 micrograms of construct. 80,000 cells were plated per well of 96-well plates. Neurons were incubated in Phase 5 media+blasticidin. Media was changed (50%) twice a week.

Phase I media: Base: Advanced DMEM/F12; Glutamax (1×) (Life Technologies #35050); Pen/Strep (1×) (Life Technologies #15140); N-acetyl-cysteine (500 micromolar); Heparin (2 micrograms/mL); SB431542 (10 micromolar); LDN193189 (100 nM); XAV939 (2 micromolar); N2 supplement (0.5% v/v).

Phase II/III media: Base: Advanced DMEM/F12; Glutamax (1×); Pen/Strep (1×); N-acetyl-cysteine (500 micromolar); Heparin (2 micrograms/ml); N2 supplement (0.5% v/v); B27 Supplement (1% v/v) (Lilfe Technologies #17504); FGF2 (10 ng/mL, first 4 days; 2.5 ng/mL, rest of Phase II/III); LDN193189 (100 nM); CHIR99021 (20 nM); Retinoic acid (5 nM).

Phase IV media: Base: Advanced DMEM/F12; GlutaMax (1×); Pen/Strep (1×); Heparin (2 micrograms/mL); N2 Supplement (0.5% v/v); B27 Supplement (0.4% v/v); Forskolin (10 micromolar); Calcium chloride (600 micromolar)

Phase V media: Base: Advanced DMEM/F12; GlutaMax (1×); Pen/Strep (1×); Heparin (2 micrograms/mL); N2 Supplement (0.5% v/v); B27 Supplement (1% v/v); Forskolin (10 micromolar); Calcium chloride (600 micromolar); BDNF (5 ng/mL); GDNF (5 ng/mL).

Generation of Insoluble Tau Fractions

Sarkosyl insoluble fractionation was performed on 6 month old 58/4 (tg/tg) transgenic mice, an in-house tau transgenic mouse model overexpressing the full-length human 0N4R isoform of tau with the P301S mutation. Briefly, brain tissue isolated from mice was homogenized in 9:1 (v/w) of high-salt buffer (10 mM Tris-HCL, pH7.4, 0.8Nacl, 1 mM EDTA, and 2 mM dithiothreitol) with protease and phosphatase inhibitor and 0.1% sarkosyl. Homogenate was centrifuged at 10,000 g for 10 minutes at 4° C., and supernatant was collected. Pellet was re-extracted two times using same buffer conditions, and all supernatants were pooled. Additional sarkosyl was added to the supernatant to reach a 1% final sarkosyl concentration. After 1 hour nutation at room temperature, sample was centrifuged at 280,000 g for 1 hour at 4° C. Finally, the resulting pellet was re-suspended in PBS (300 ul/g of tissue) and briefly sonicated (20% power for 10, 10-second cycles) using hand-held probe (QSonica). This final fraction was stored at −80° C. until use and was referred to as the sarkosyl insoluble tau fraction.

Results

Figure 23:
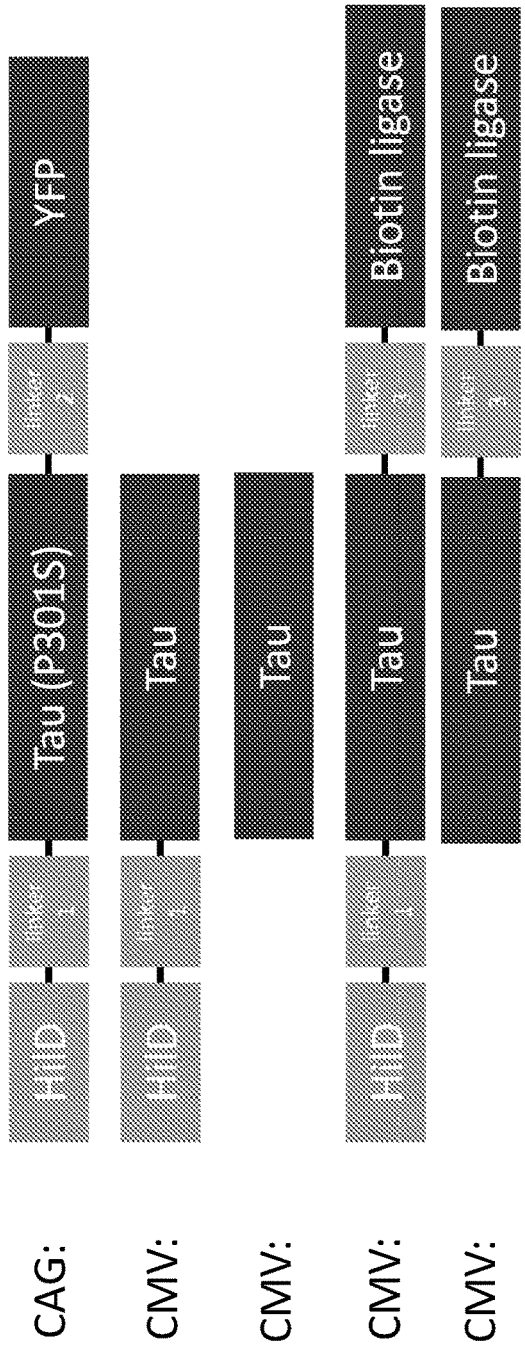
FIG. 23 is a set of schematics showing HilD-Tau fusion constructs. The 0N4R Tau isoform was used, which includes the C-terminal repeat domain exon but does not include the N-terminal exons. Lentiviral constructs were used, though all the constructs were introduced through lipofectamine transfection or nucleofection. Tau fusion products were expressed downstream of CAG or CMV promoters.

HilD-Tau fusions, including aggregation prone Tau mutations, were generated to build tools to monitor the degradation of the aggregation-prone, toxic forms of Tau protein (FIG. 23).

Figure 24A:
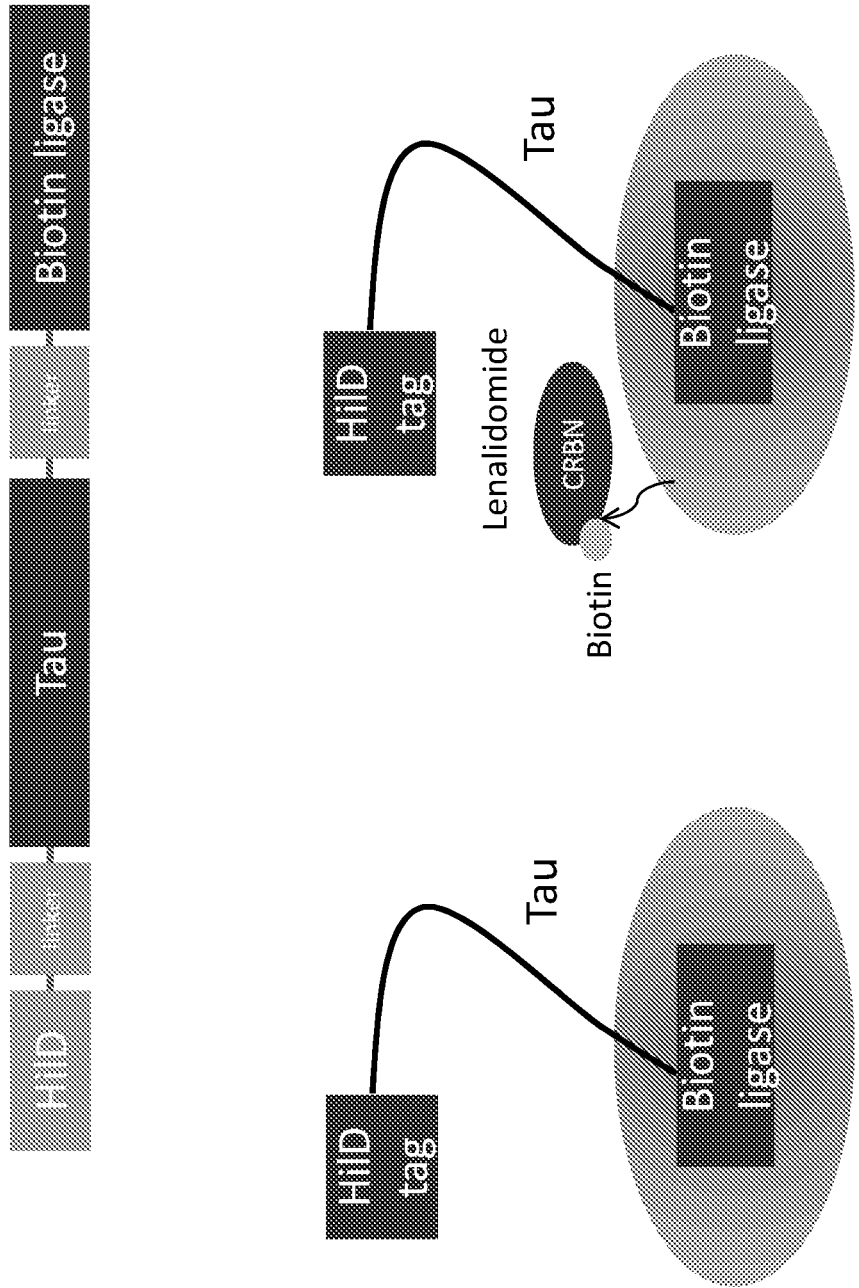
FIGS. 24A and 24B are graphs showing design and results from a study examining the recruitment of the E3 ligase CRBN to HilD-Tau fusion proteins.
Figure 24B:
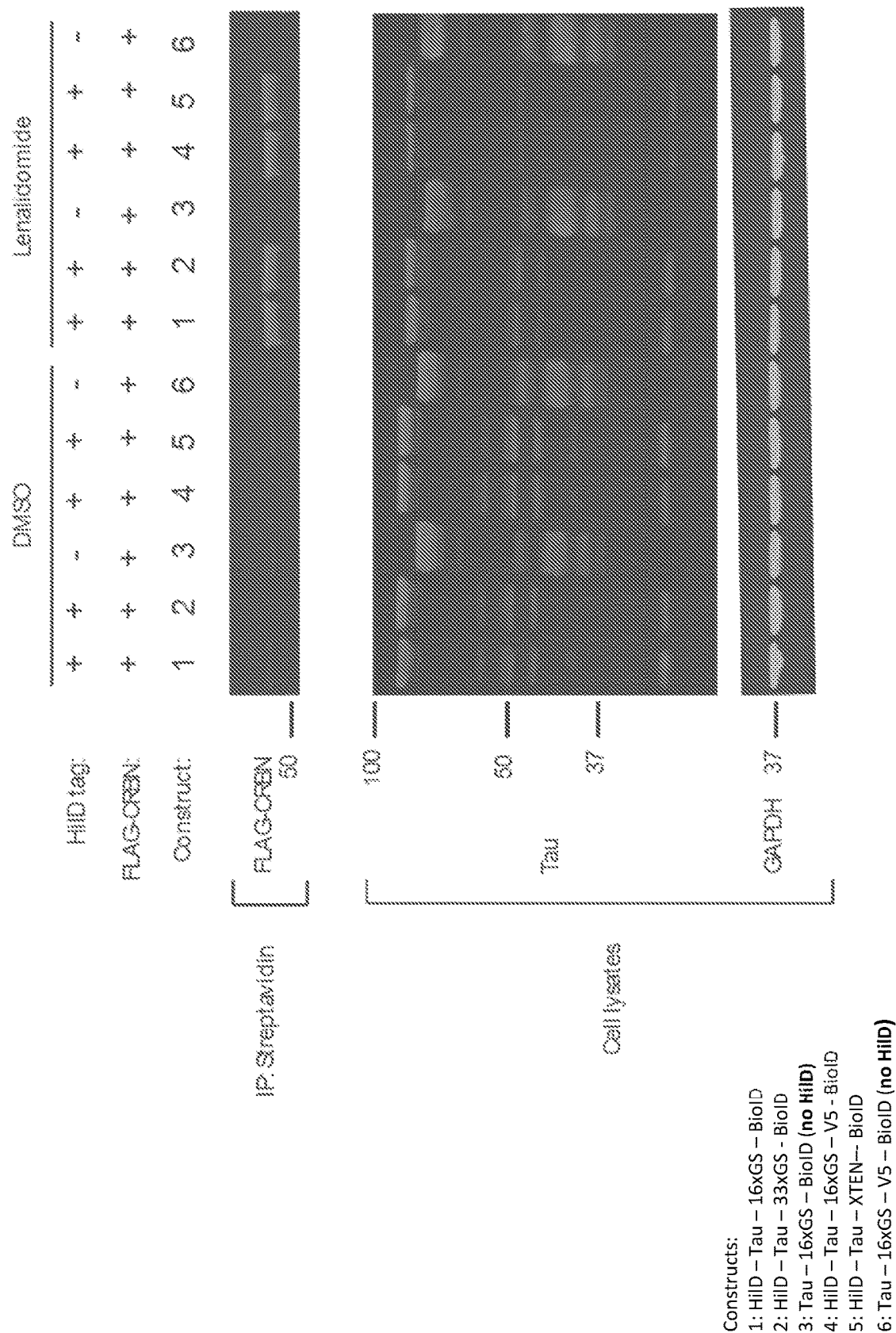

In a first experiment, it was tested whether fusion of the HilD tag to Tau could induce the recruitment of the E3 ligase Cereblon (CRBN) via treatment with the immunomodulatory drug lenalidomide. A HilD-Tau-biotin ligase fusion was generated (FIG. 24A). Biotin ligase, upon exposure to biotin, generates reactive biotin species that covalently binds to proximate proteins within a radius of tens of nanometers. Upon treatment with Lenalidomide, but not in control conditions, HilD-Tau-biotin ligase caused robust biotionylation of a FLAG-tagged CRBN construct co-transfected with HilD-Tau-biotin ligase constructs in HEK293T cells (FIG. 24B). This confirms that the HIID tag can recruit CRBN to Tau via lenalidomide ternary complex formation.

Next, it was examined whether Tau could be degraded by CRBN recruitment in heterologous cells. HEK293T cells were transfected with a toxic, aggregation-prone form of Tau, 0N4R Tau P301S, fused with an N-terminal HilD tag and a C-terminal YFP (yellow fluorescent protein) reporter. Expression of this construct leads to toxicity over time in cells. Treatment with lenalidomide reduced YFP expression (FIGS. 25A and 25B) and improved viability of the HEK cells (FIG. 25C). This indicates that the HilD-Tau fusion can be used to reveal cytoprotective action of degradation of toxic Tau proteins, as found in neurodegenerative diseases.

Figure 26A:
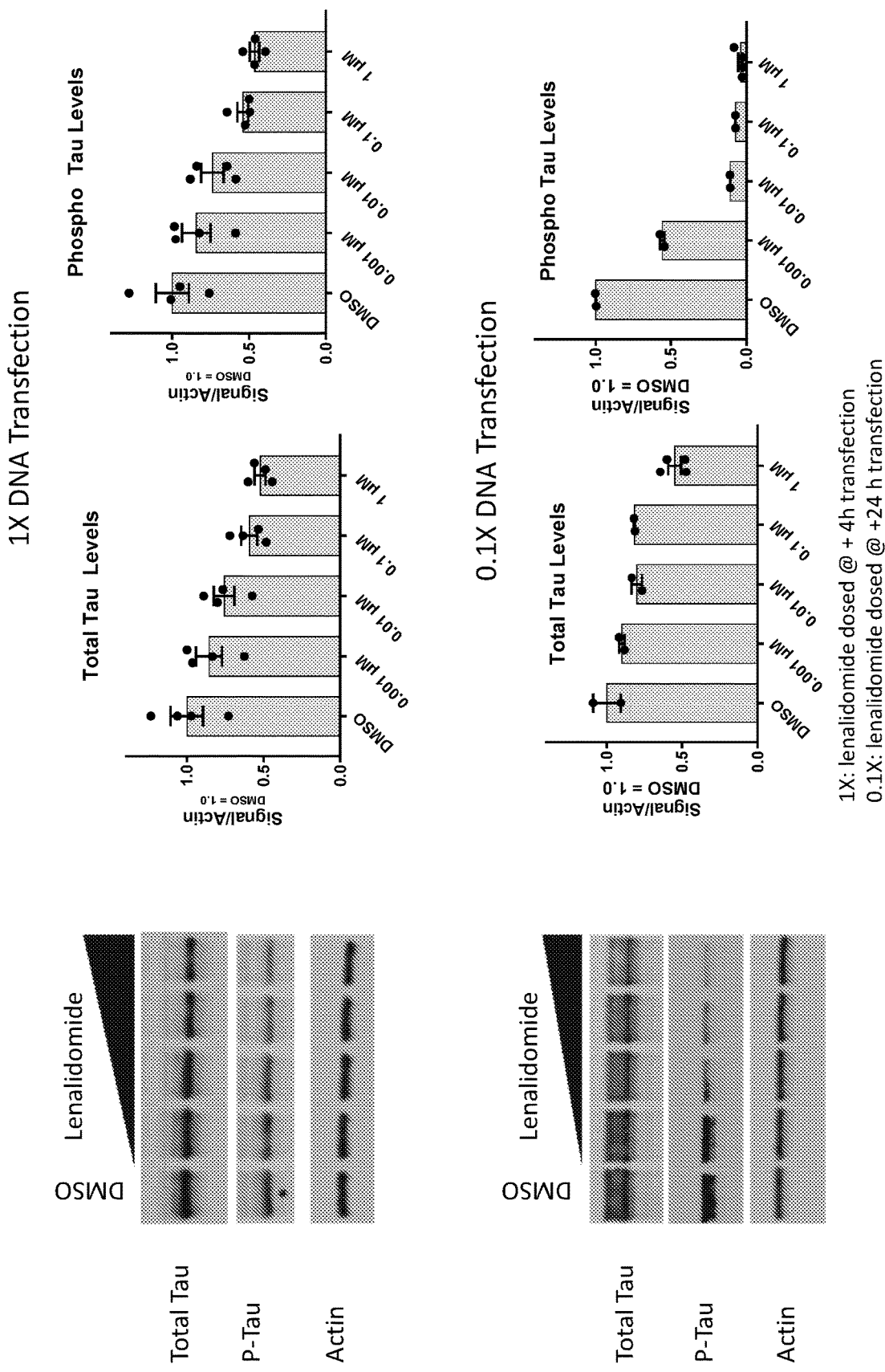
FIGS. 26A, 26B, 26C, and 26D are graphs showing quantification of Tau protein reduction and reduction of specific forms of Tau in HEK293T cells by inducible recruitment of CRBN.

Furthermore, it was tested whether Tau lacking an YFP tag would be degraded in HEK293T cells. Lenalidomide treatment reduced Tau levels, as quantified by Western analysis versus Actin loading control (FIG. 26A). Interestingly, decreasing the amount of Tau expression by lowering the amount of DNA transfected increased the efficiency of degradation, particularly of a phosphorylated form of Tau (FIG. 26A, bottom panels). This suggests that the system may be used to explore the capacity of the E3 ligase and proteasome system to degrade different levels of the Tau protein, and additionally that this system may be used to explore selective vulnerability of specific forms of a toxic protein to inducible degradation. The enhanced reduction of phosphorylated Tau suggests either that a specific subtype of Tau is more susceptible to degradation or that a fragment of Tau containing this epitope is more greatly degraded than other isoforms of Tau.

Figure 26B:
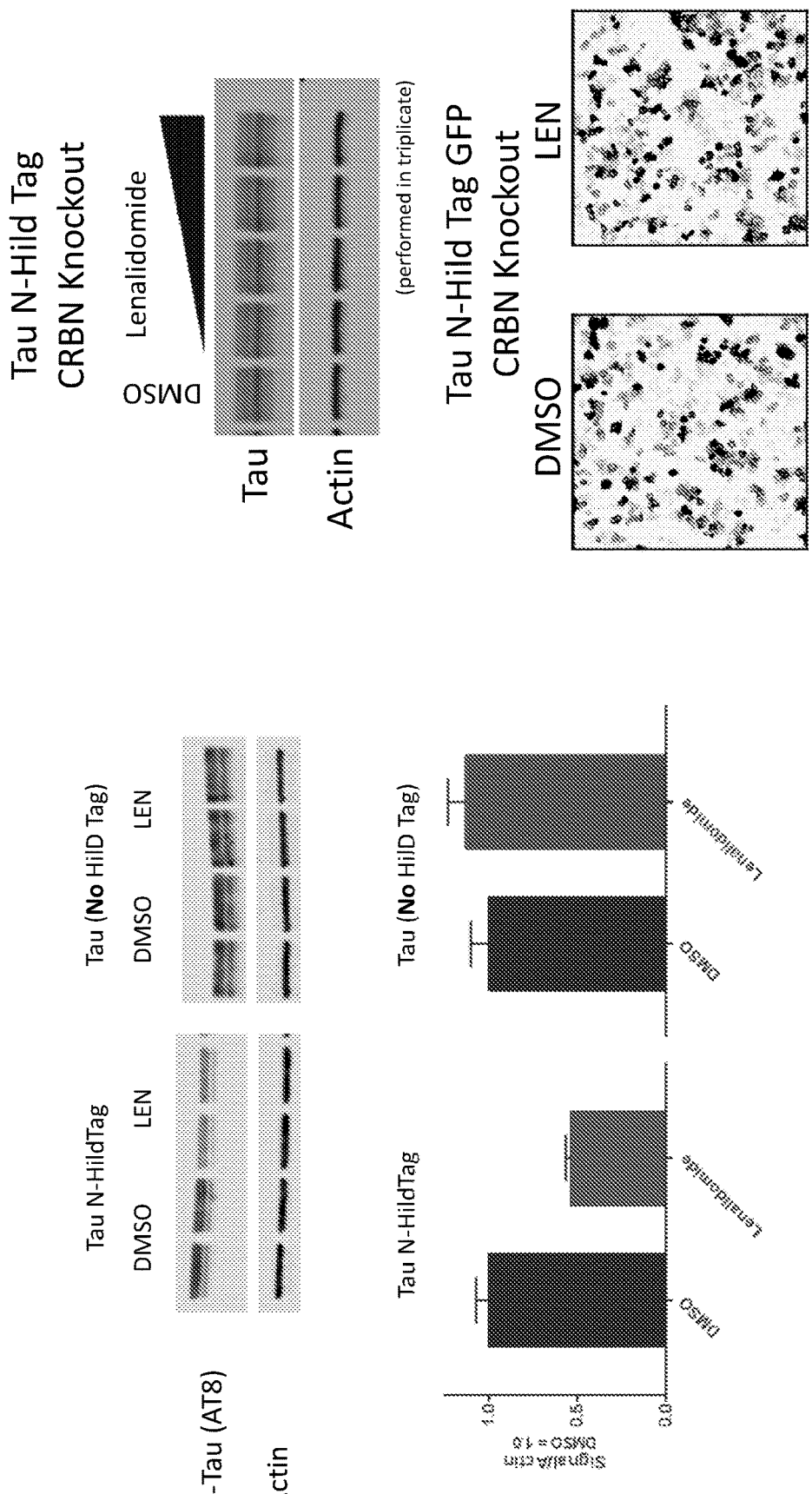
Figure 26C:
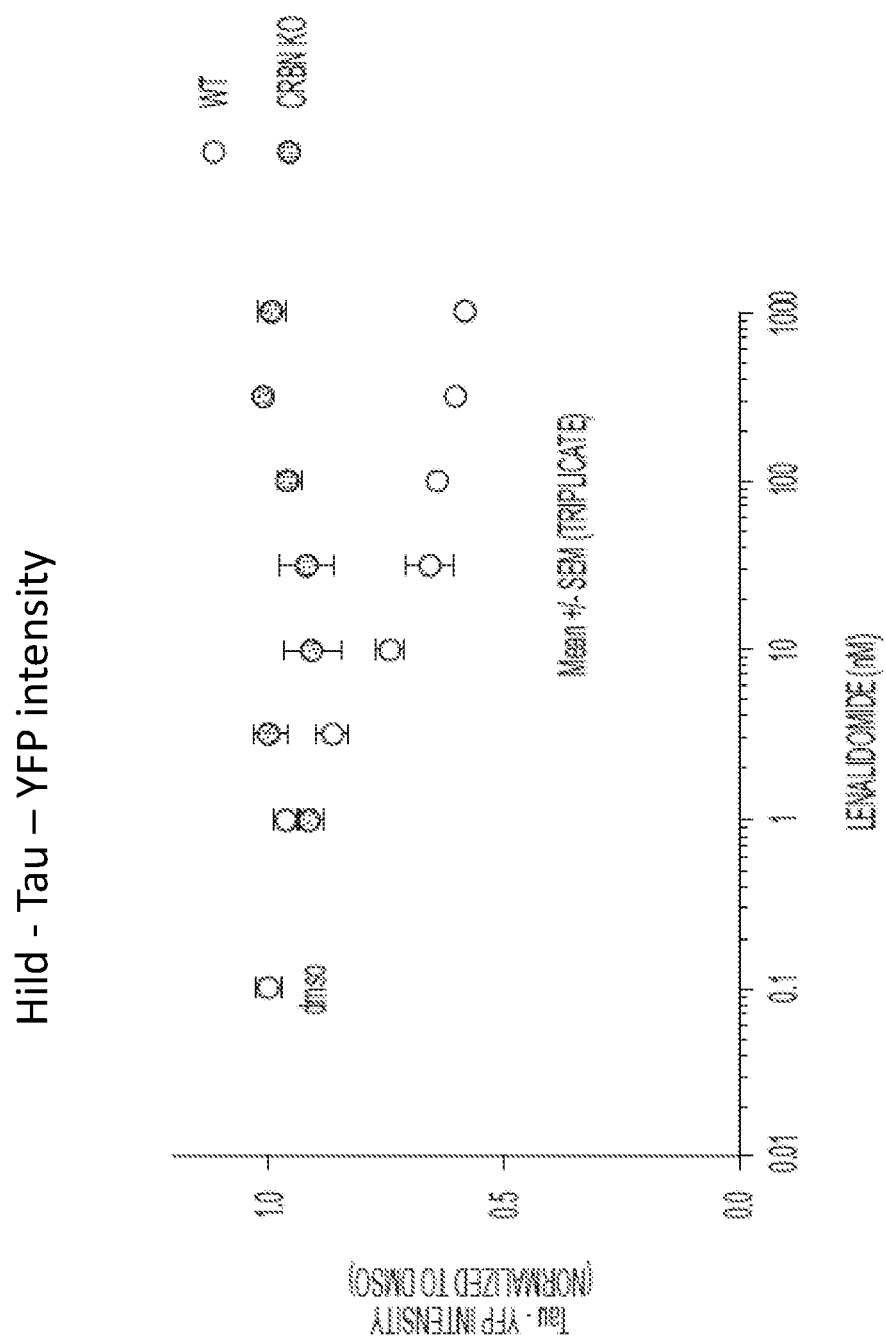
Figure 26D:
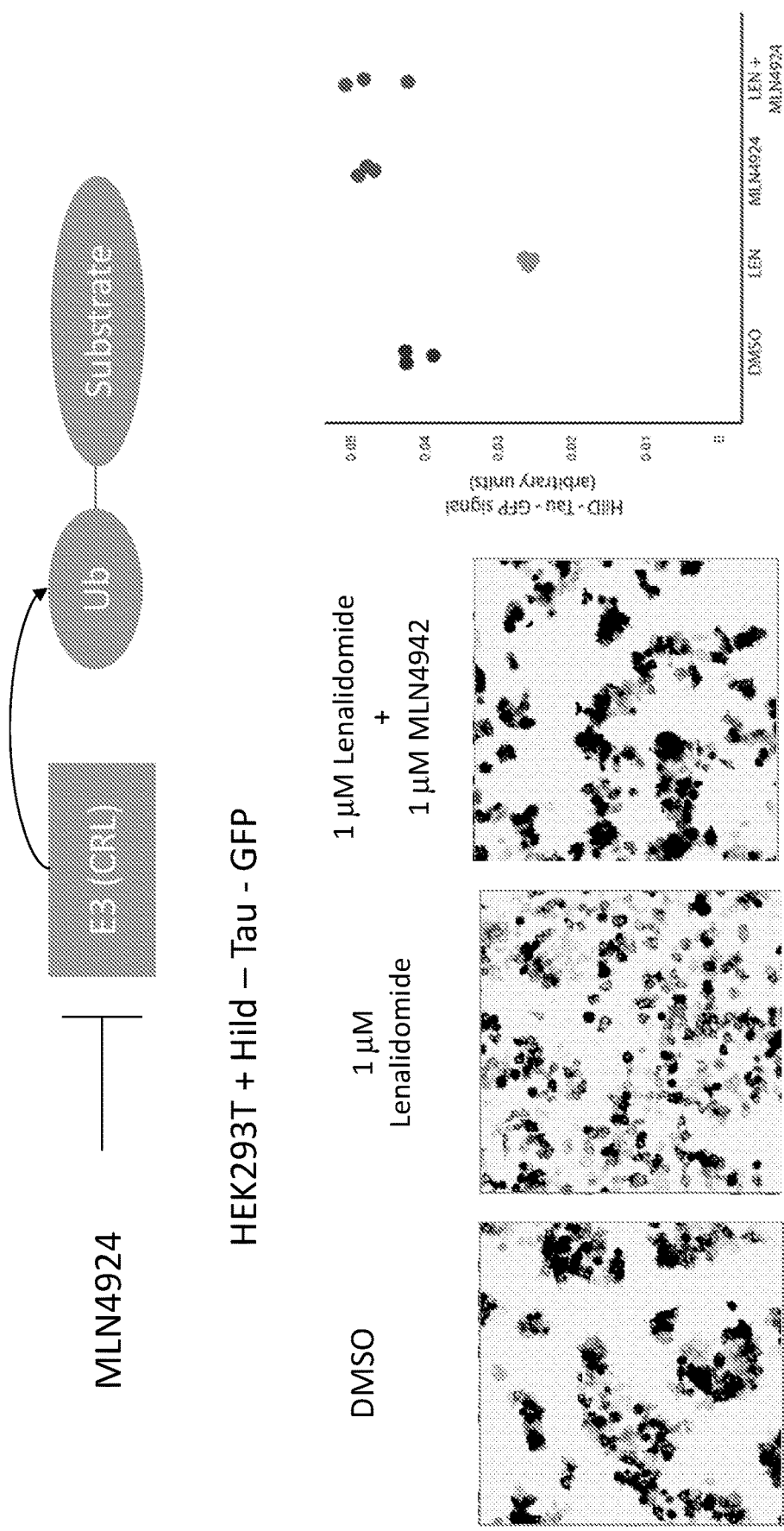

In a series of control experiments to further verify that the degradation of Tau was mediated via CRBN E3 ligase recruitment, the degradation of HilD-Tau or HilD-Tau (P301S)-YFP was tested in HEK293T cells lacking CRBN, and it was confirmed that no degradation occurred (FIGS. 26B and 26C). Further, degradation was sensitive to the Neddylation inhibitor MLN4924 (FIG. 26D). Neddylation is essential for the activity of the E3 ligase CRBN, indicating that the ubiquitinating activity of CRBN is needed for Tau targeted degradation.

Figure 27:
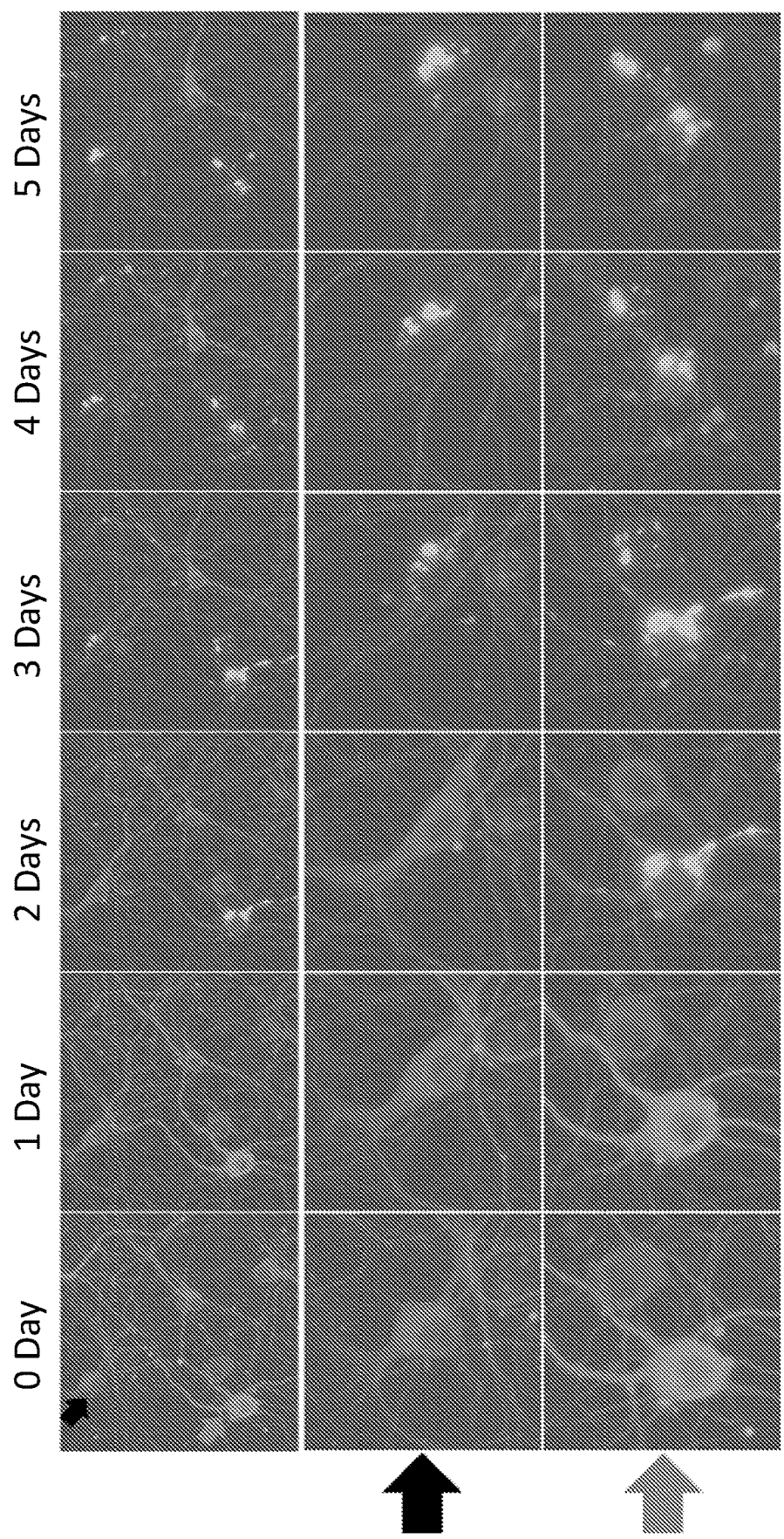
FIG. 27 is a set of graphs showing assessment of aggregation propensity of HilD-Tau (P301S)-YFP fusion, expressed in rodent cortical neurons. Rodent cortical neurons were nucleofected with HilD-Tau (P301S)-YFP fusion, and then subsequently incubated with insoluble Tau fractions isolated from a Tau transgenic mouse, generated in-house. Live YFP fluorescence was imaged using InCell 6000 Analyzer. Middle and bottom panels show zoom-in of neurons identified in the top panel. Tau aggregates, as shown by intense, punctate YFP fluorescence, are clearly visible.

Next, it was explored whether Tau could be degraded in neurons, which are the disease relevant cell type for Tau-mediated neurodegenerative diseases, and whether this process of degradation, by ubiquitinating Tau, would produce any aggregated Tau as byproduct. First, it was established that HilD-Tau (P301S)-YFP fusions were competent for aggregation, by treating neurons nucleofected with this construct with an insoluble fraction of rodent brain, isolated from a transgenic mouse overexpressing mutant Tau. Aggregation of the HilD-Tau (P301S)-YFP was clearly visible, as shown by intense, punctate YFP fluorescence within the cell body and dendrites of neurons (FIG. 27).

Figure 28:
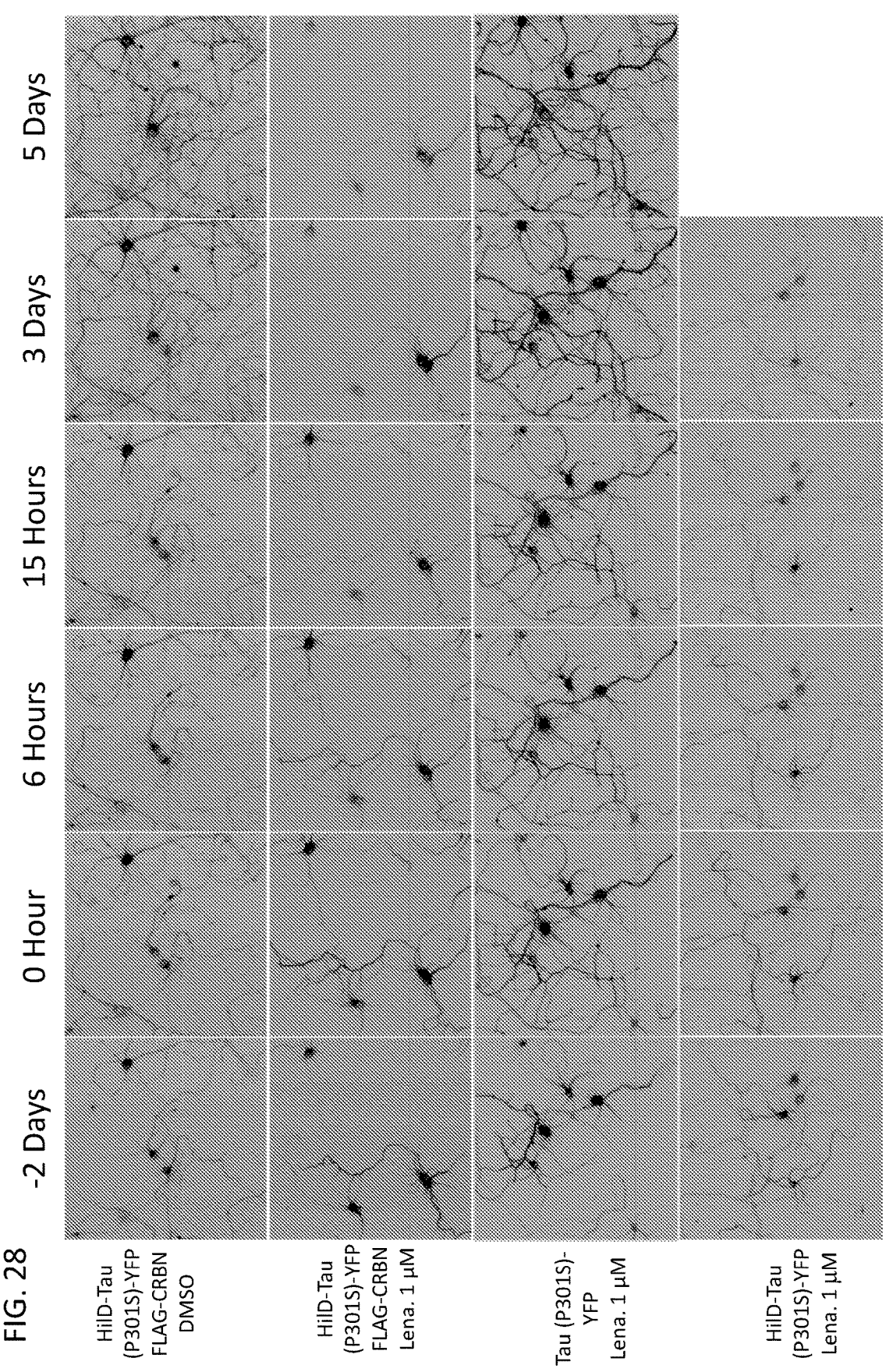
FIG. 28 is a set of graphs showing lenalidomide mediated degradation of HilD-Tau (P301S)-YFP expressed in rat neurons. Rodent cortical neurons were nucleofected with HilD-Tau (P301S)-YFP fusion, or Tau (P301S)-YFP fusion. Co-transfection with FLAG tagged CRBN was also tested (top rows). Beginning at 9 days in vitro, neurons were treated with indicated doses of lenalidomide. Neurons were imaged live for YFP fluorescence at indicated intervals. Lenalidomide treatment reduced YFP intensity over time relative to HilD-Tau (P301S)-YFP expressing neurons treated with DMSO or Tau (P301S)-YFP expressing neurons treated with lenalidomide. Degradation occurred either with or without co-transfection of human CRBN, indicating that the HilD-Tau fusion can be degraded by lenalidomide by either rodent or human CRBN.
Figure 29:
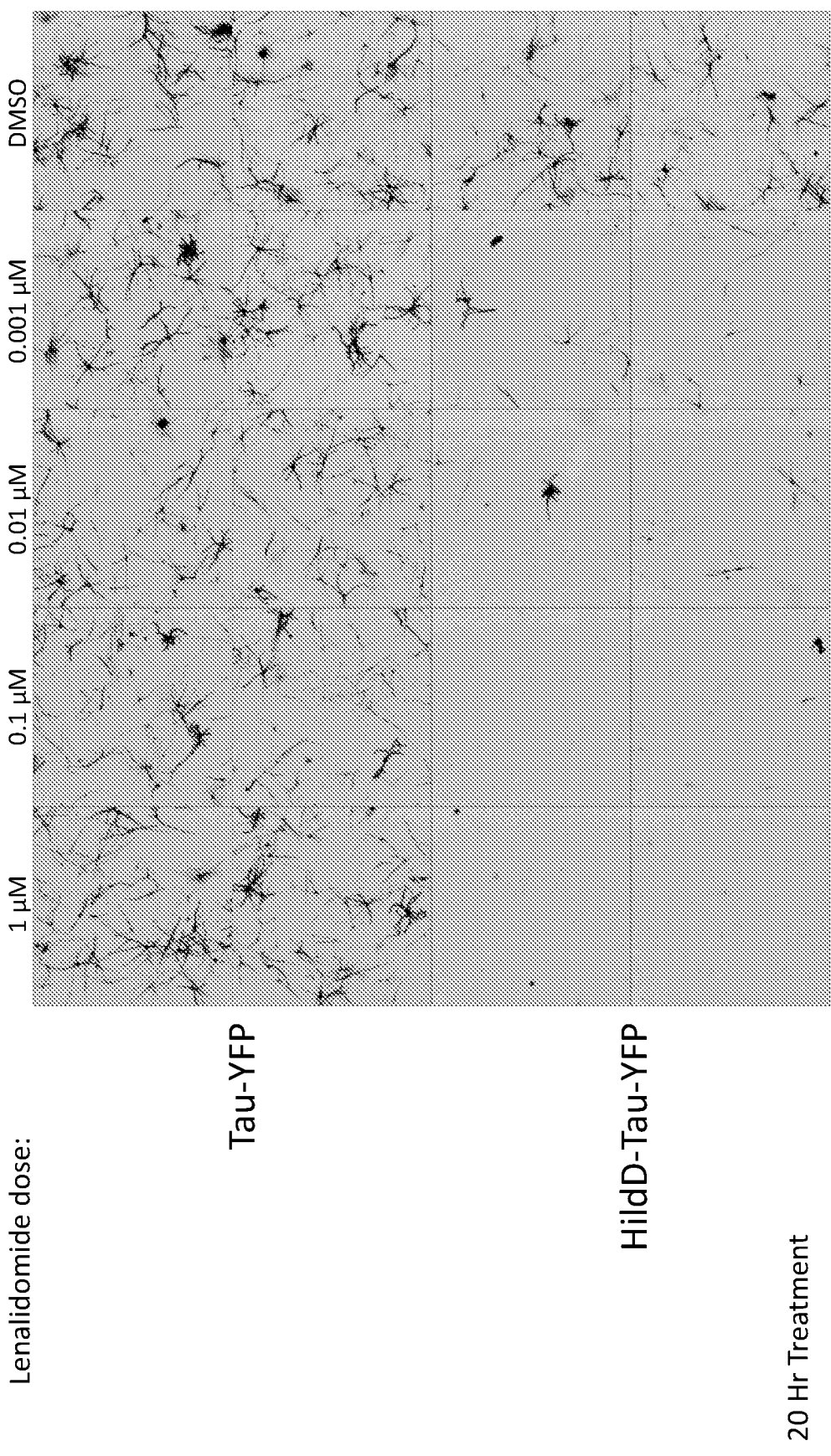
FIG. 29 is a set of graphs showing lenalidomide mediated degradation of HilD-Tau (P301S)-YFP expressed in rat neurons. A single-cell suspension of dissociated 63 days in vitro old human neurospheres, derived from embryonic stem cells, was nucleofected with HilD-Tau (P301S)-YFP. Neurospheres contain both neurons and neuronal progenitors. After 10 days in culture, neurons were treated with lenalidomide (at a total age of 73 days in vitro). Images show YFP fluorescence after 20 hours of lenalidomide treatment, at indicated dose. Lenalidomide substantially reduced YFP fluorescence intensity in a dose dependent fashion.

In addition, the degradation sensitivity of HilD-Tau (P301S)-YFP in rat primary cortical neurons prepared from embryonic tissue, as well as in neurons and neuronal progenitors transfected from neurospheres derived from human embryonic stem cells was tested (FIGS. 28 and 29). In primary neurons, HilD-Tau (P301S)-YFP was tested for lenalidomide induced degradation both alone and when co-transfected with FLAG-tagged human Cereblon. Although so-called immunomodulatory drugs such as thalidomide and lenalidomide are reported to exhibit different effects in rodents than humans, such as teratogenicity, in this system lenalidomide induced degradation of HilD-Tau-YFP even when not co-transfected with human CRBN (FIG. 28). This indicates that this system may work in rodent systems, such as by knocking in the HilD Tau into transgenic mice to assess the impact of degrading Tau in neurodegenerative disease animal models. The HilD-Tau-YFP constructs demonstrated a subcellular distribution in neurons consistent with the physiological localization of Tau, across the cell body and processes. Lenalidomide degradation revealed a widespread reduction in Tau levels across the neuronal cell body, indicating that the system can be used to verify that the E3 ligase CRBN is likely to be distributed across compartments of the neuronal cell body. The use of the YFP label for this system also enabled straightforward determination of the kinetics of degradation, using repeated live-cell imaging across time. Degradation was robust in both rodent and human neurons (FIG. 29), serving as proof of principle for Tau targeted protein degradation in neurons. In neither case was there any visible evidence of aggregated Tau formed by the lenalidomide mediated recruitment of CRBN.

Because the HilD-Tau system can be induced to aggregate, it is envisioned that it can be used to assess situations in which aggregated Tau is or is not able to be ubiquitinated and degraded by the proteasome.

Example 11: Evaluation of CAR19-HilD in Jurket Cells

This study examines the kinetics of lenalidomide on CAR19-HilD in Jurkat cells and whether CAR19 expression could return after lenalidomide was washed off cells.

Methods

Cell treatment: CAR19-16GS-HilDtag-transduced Jurkat cells were diluted and seeded in two flasks. Once the cells were plated, one flask was treated with DMSO and the other with 10 µM lenalidomide for a time course harvest. 3 ml of cells from each flask were harvested for flow cytometry and western blot at 1, 2, 4, 6, 8, 12, and 24 hours post compound treatment. The cells in the lenalidomide-treated flask were split into two flasks at 24-hour time point. One was labelled "washout" and the other was "treatment". Lenalidomide was washed out of the "washout" cells by centrifugation at 300 g and resuspended in fresh media three times, and the other half was split with the residual lenalidomide present in the medium from before (10 µM lenalidomide treatment was carried out only once). Cells were collected at 1, 2, 4, 6 hours post washout and 36, 48, 60 and 72 hours post compound treatment.

Western blot: Cells were pelleted, washed with PBS, and pellets were lysed with 50 µl RIPA buffer (Boston Bioproducts BP-115D) with protease inhibitors (Roche 04693124001). Lysates were centrifuged, supernatant transferred to new tubes and protein quantities read by Lowry Assay (BioRad 5000111). Each sample was normalized to 30 µg total protein in a 20 µl volume with 4× sample buffer (Thermo Scientific NP0007) and 10× reducing agent (Thermo Scientific NP0009). Samples were run on a 4-12% Bis-Tris acrylamide gel (Thermo Scientific WG1402BOX). The gels were run in duplicate, one to be probed against actin and the other against V5 or CD3Z. Gels were transferred to nitrocellulose membranes and the membranes were incubated overnight in 3% milk in TBS-0.1% Tween-20 with one of the following antibodies: mouse anti-actin (Sigma Aldrich A5441) at 1:10000 dilution and mouse anti-CD3z (BD 551034) at 1:1000 dilution. Blots were washed the following day in TBS-0.1% Tween-20, placed in 3% milk in TBS-0.1% Tween-20 with 1:10000 sheep-anti-mouse HRP secondary antibody (GE Healthcare NA931) at room temperature for 1 hour, then blots were washed and developed with ECL (Thermo Scientific 34076).

Flow cytometry: Cells were harvested in u bottom plate and washed using 1×PBS. The washed cells were stained with 100 µL Biotinylated Protein L (Genscript M00097) diluted at 1:1000× at 1 µg/ml. The primary antibody was incubated at 4° C. for 45 mins After incubation the cells were washed using PBS. Cells were incubated at 4° C. with PE conjugated Streptavidin (Jackson Lab 016-110-084) at 1:300× dilution for 30 mins. The cells were washed twice with PBS and suspended in 100 µL fixation buffer (2% Paraformaldehyde in PBS) for 10 mins at room temperature. The fixed cells were washed with PBS and suspended in 150 µL PBS. These cells were then acquired using BD LSRF Fortessa cell analyzer. The dead cells were excluded based on the size using the FSC and SSC plot. The live cells were analyzed for their PE CAR expression. FACS results were gated using unstained JNL parental cell line and 10 k events were recorded for each sample.

Results

Figure 30A:
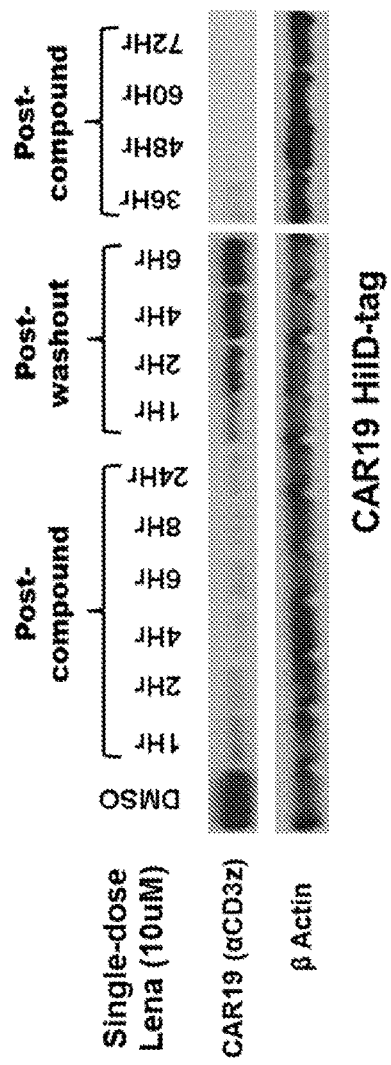
FIGS. 30A and 30B are a set of graphs showing lenalidomide mediated degradation of CAR19-16GS-HilDtag.
Figure 30B:
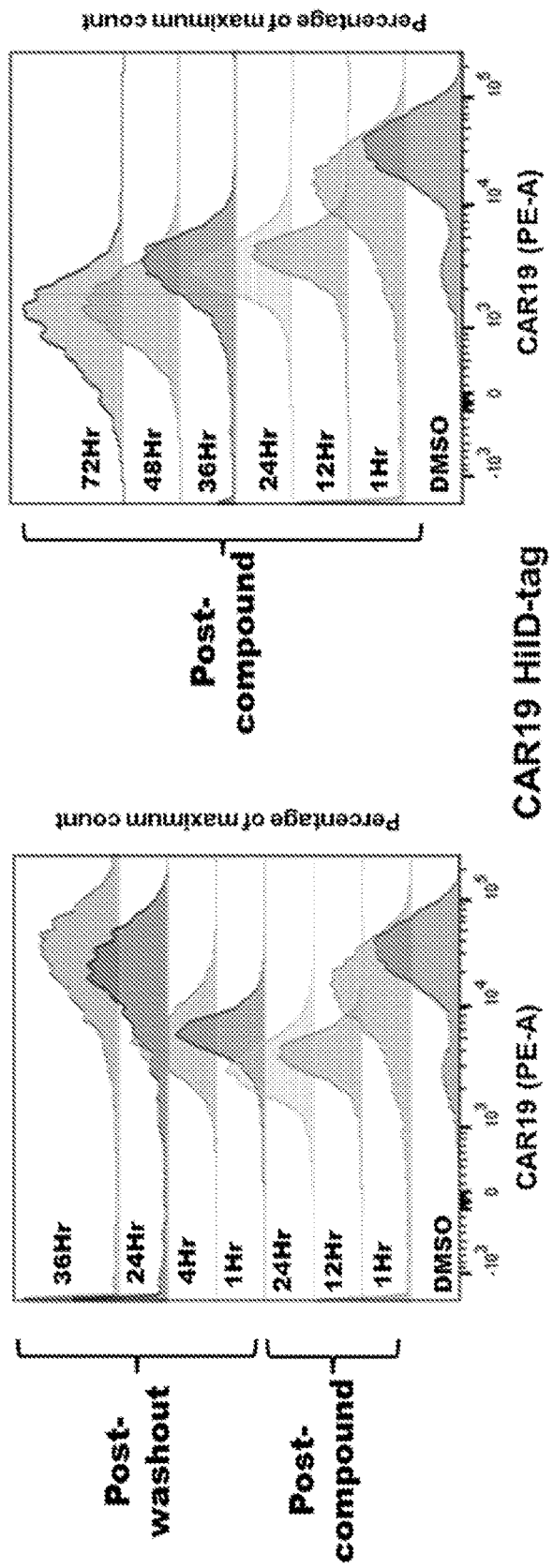

As shown using Western blot in FIG. 30A, 10 µM lenalidomide degraded CAR19-HilD in a time-dependent manner and after lenalidomide was washed out, CAR19-HilD expression recovered. This observation was confirmed using flow cytometry analysis. Lenalidomide continued to degrade CAR19-HilD over time and washing out lenalidomide increased CAR19-HilD surface expression (FIG. 30B).

Example 12: Evaluation of CAR19-HilD in Primary T Cells

This study analyzes the dose-response effect of lenalidomide on CAR expression and function in primary T cells.

First, the surface expression of CAR in CAR19-HILD CART cells with or without lenalidomide treatment for 24 and 48 hrs was examined Second, the impact of lenalidomide on CAR T killing and cytokine production in the presence of CD19-expressing cells was analyzed.

Methods pELPS vector viral production: LentiX-293T cells (Clonetech 632180) were cultured in DMEM with 10% FBS at 37° C. and 5% $CO_2$. Cells were seeded in five 15 cm tissue culture plates (BD Biosciences 356451) at $14 \times 10^{\wedge}6$ cells per plate in 25 ml of DMEM, 10% FBS and incubated overnight. On the following day, 15 µg of the pELPs vector was combined with a lenti-viral packaging mix (18 µg pRSV.REV, 18 µg pMDLg/p.RRE, and 7 µg pVSV-G), 90 µl Lipofectamine 2000 (Invitrogen 11668-019) and 3 ml OptiMEM (Invitrogen 11058021) per 15 cm plate and added to the plated cells. On the following day, the media was removed and replaced with 15 ml of fresh media. Cells were incubated for 30 hours and then virus was harvested, centrifuged at 500 g for 10 min, and filtered through a 0.45 µM cellulose acetate filter (Corning 430314). The viral supernatant was concentrated using Lenti-X concentrator (Clonetech 611232) at 4° C. overnight, pelleted at 1500 g for 45 min at 4° C., followed by supernatant aspiration and resuspension in DMEM, 10% FBS at 1/100th of the initial volume. Virus was aliquoted and stored at −80° C.

SUPT1 Titer: 100 µL of SUPT1 cells were plated at 2E5 cells/ml in a flat bottom 96 well plate. 50 µL of diluted virus was added to the cells. The plate was incubated at 37° C. in $CO_2$ overnight. 100 µL RPMI media was added to each well and the plate was returned to the incubator. On Day 4 of transduction, the cells were harvested and stained for Protein L and CAR expression was analyzed using Flow Jo.

10 days CART expansion: CART cells were generated by starting with apheresis product from healthy donors whose naive T cells were obtained by negative selection for T cells, CD3 lymphocytes. T cells were cultured at $0.5 \times 10^6$ T cells in 1 mL medium per well of a 24-well plate. These cells were activated by the addition of CD3/CD28 beads (Dynabeads® Human T-Expander CD3/CD28) at a ratio of 1:3 (T cell to bead) in T cell media.

After 24 hours, T cells were left untransduced (UTD) or transduced at a multiplicity of infection (MOI) of 4 for CART19 or CART19-HilD. T cell growth was monitored by measuring the cell counts per mL, and T cells were diluted in fresh medium every two days. On day 7, 1 million cells were transferred to a 24 well plate to assess the effect of lenalidomide, at three different concentrations 1 µM, 0.1 µM, and 0.01 µM, for 24 hrs or 48 hrs. The percentage of transduced cells (cells expressing the CD19-specific CAR on the cell surface) was determined by flow cytometry analysis on a FACS Fortessa (BD).

FACS Staining:

Cells were harvested and washed with PBS. The cells were then incubated with 100 µL Biotinylated Protein L at 4° C. for 45 mins. The cells were then washed using PBS and incubated at 4° C. with PE conjugated Streptavidin at 1:300× dilution and BV421 CD3 antibody at 1:200 dilution, for 30 mins. The cells were then washed twice with PBS and suspended in 100 µL fixation buffer 2% Paraformaldehyde for 10 mins at room temperature. The fixed cells were washed with PBS and suspended in 150 µL PBS. These cells were then acquired in a Fortessa instrument and the results analyzed using Flow Jo software.

The frozen CART cells were thawed in T cell media and co-cultured with either CD19 negative (K562 Cells) or CD19 positive target cells (Nalm6 cells), both expressing luciferase. Both the number of CART cells and the total number of T cells were normalized across samples; the latter was achieved by adding UTD cells. A titration of CART cells was done keeping the target cell number constant at 25,000 cells. The highest effector:T cell ratio (E:T) explored was 20:1 and a 8 point dilution curve was used. Lenalidomide was added at a 1 µM final concentration. The co-culture experiment was conducted in clear bottom black plates in a final volume of 200 µL. Upon a 20 hr incubation, 100 µL of supernatant was removed and cytokine levels were measured. To the rest, 100 µL Bright-Glo Luciferase assay reagent (substrate+enzyme) was added and incubated for 10 minutes, at room temperature. The % Killing was measured using the formula: Specific lysis (%)=(1−(sample luminescence/average maximal luminescence))*100.

Results

Figure 31A:
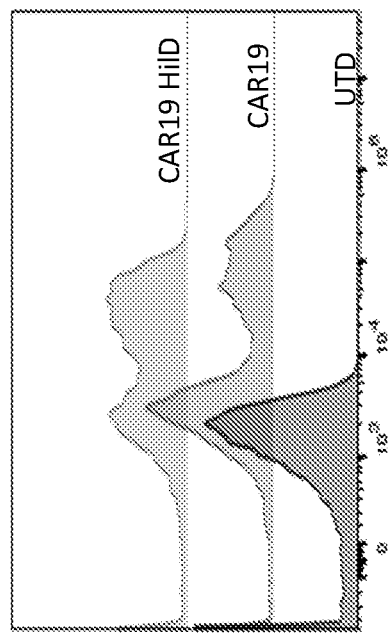
Figure 31B:
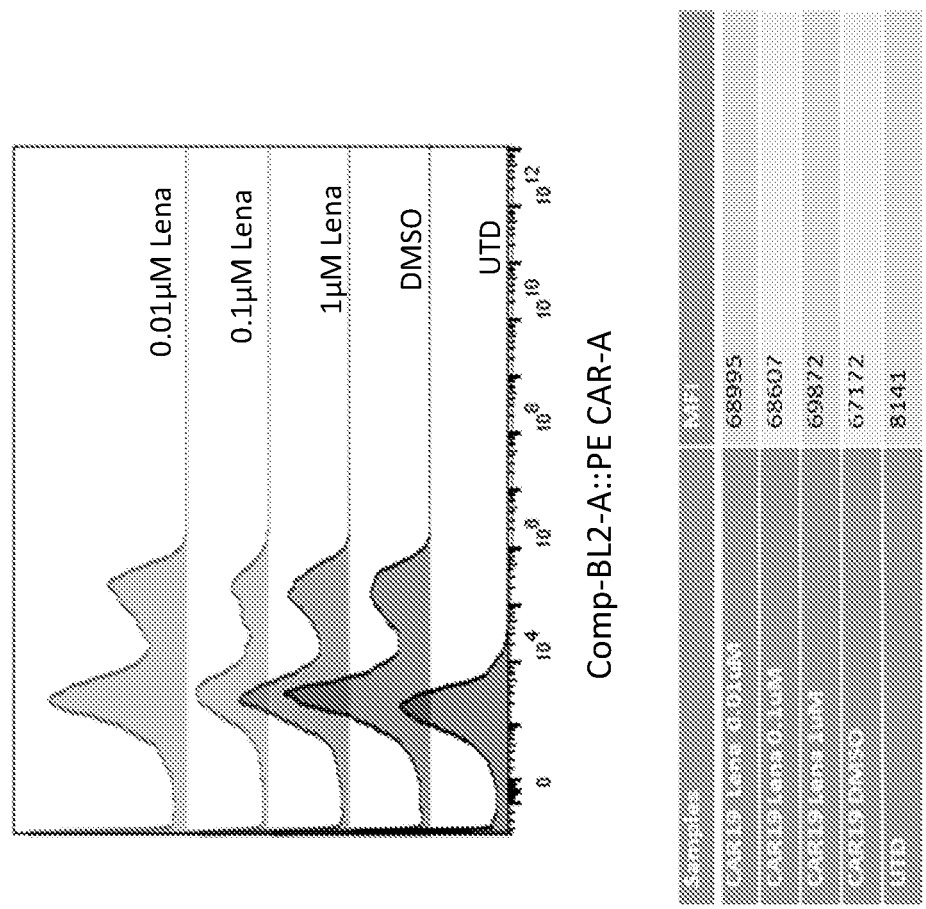

As shown in FIG. 31A, the transduction efficiency of CAR19 and CAR19-HilD was comparable. The fold expansion of primary T cells transduced with CAR19 or CAR19-HilD was also comparable. Lenalidomide treatment did not affect expression of CAR19 (FIG. 31B). In contrast, cells expressing CAR19-HilD showed dose-dependent reduction of CAR expression under lenalidomide treatment (FIG. 31C). The impact on CAR expression was more pronounced at 48 hours (FIG. 31C).

Figure 32A:
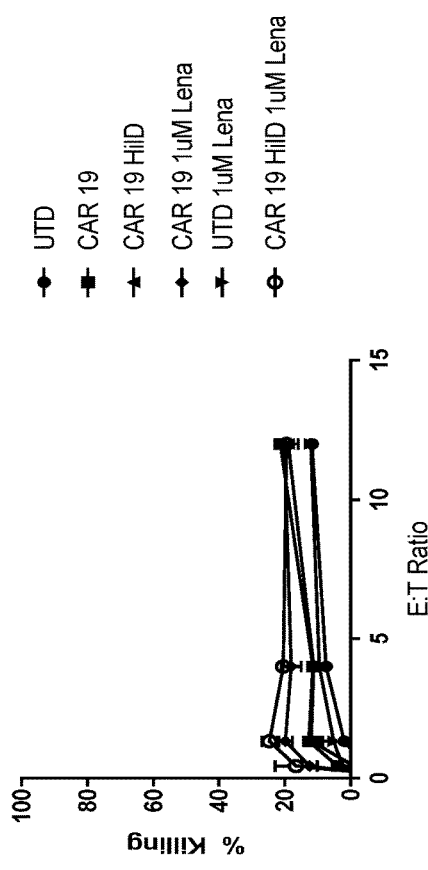
FIGS. 32A, 32B, and 32C are a set of graphs showing % killing mediated by CART cells.
Figure 32B:
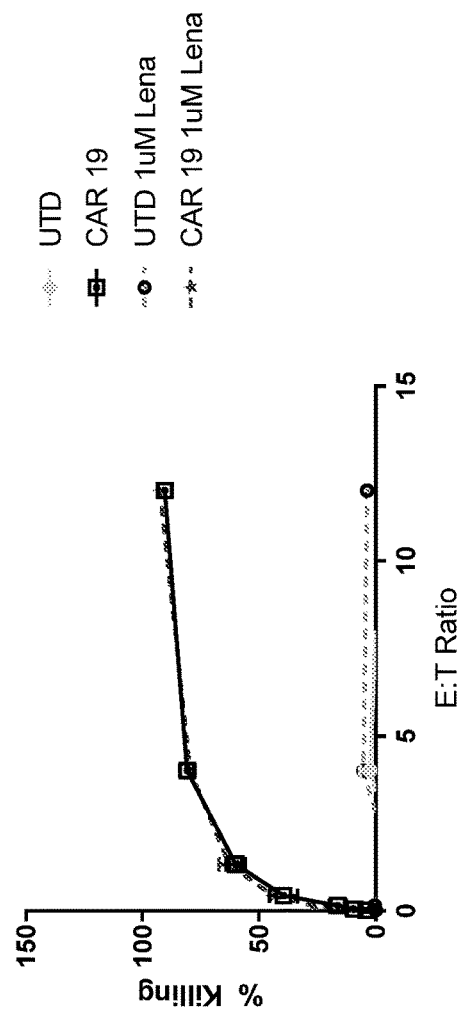
Figure 32C:
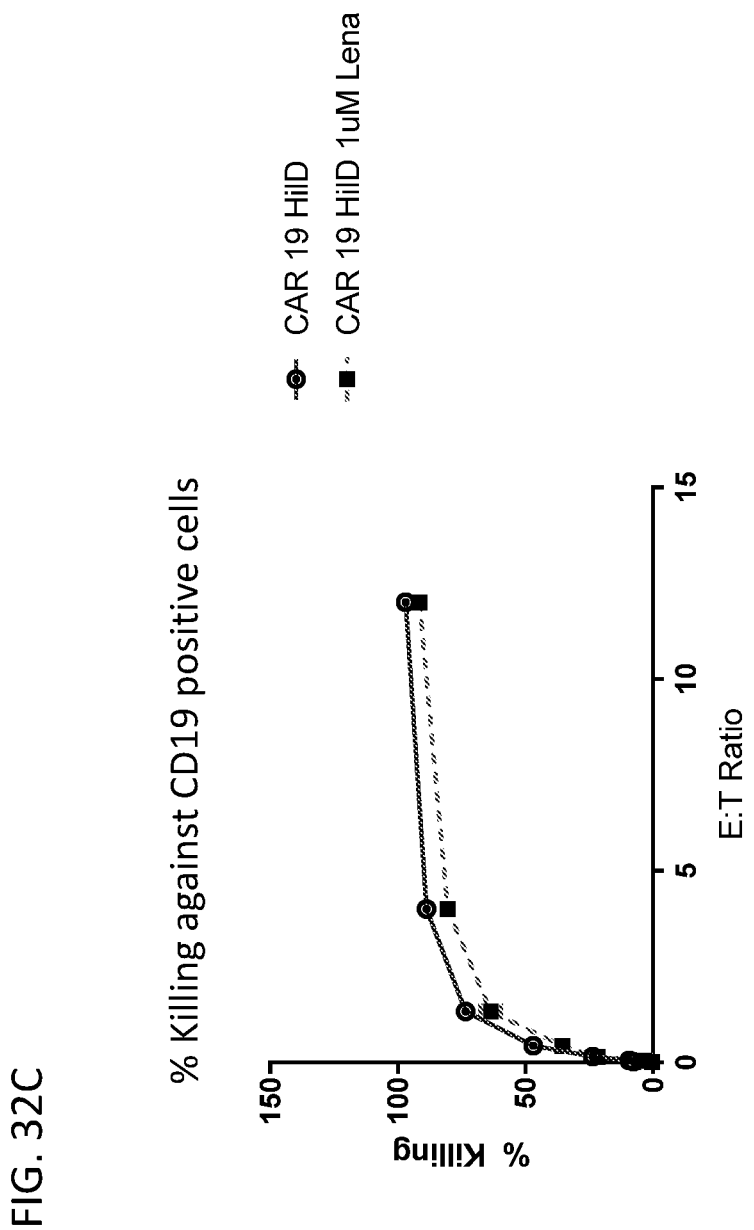

Low background killing against CD19 negative cells was observed across samples, regardless of the addition of lenalidomide (FIG. 32A). The ability of CART19 and CART19-HilD to kill CD19-positive cells in the absence of lenalidomide was comparable (FIGS. 32B and 32C). Upon lenalidomide addition, the killing curve of CART19-HilD slightly shifted (FIG. 32C).

Figure 33A:
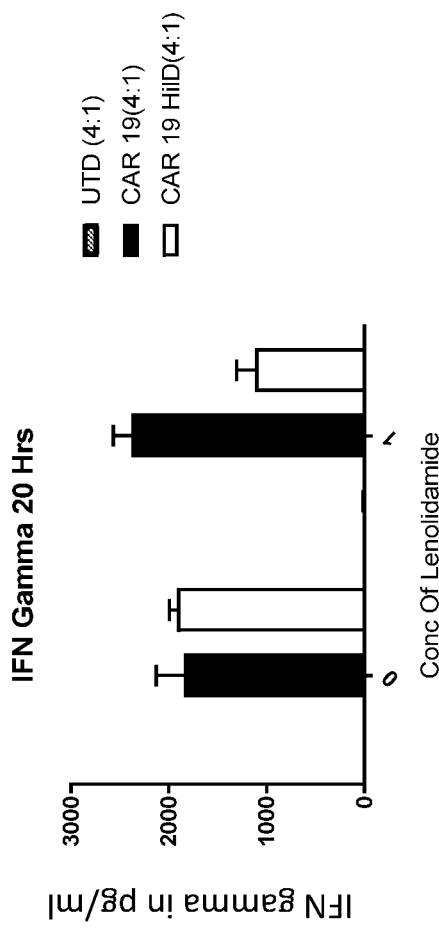
FIGS. 33A and 33B are graphs showing the levels of secreted IFN gamma and IL2, respectively, from T cells expressing CAR19 or CAR19-HilD in the presence or absence of 1 µM lenalidomide. On the x-axis, the concentration of lenalidomide is shown in µM.
Figure 33B:
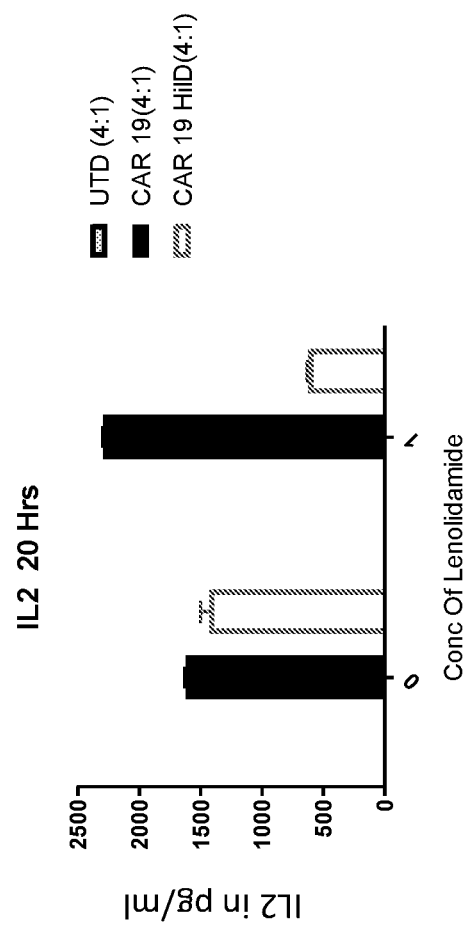

CART19 and CART19 HilD secreted comparable levels of IFN gamma (FIG. 33A) and IL2 (FIG. 33B) in response to CD19 positive cells in absence of lenalidomide. In presence of lenalidomide, the levels of secreted IFN gamma and IL2 by CART19 HilD cells decreased (FIGS. 33A and 33B). The ability of CART19 to secrete cytokines was immune to the addition of lenalidomide (FIGS. 33A and 33B).

In summary, this study demonstrates that appending the HilD tag to the CAR19 structure has no impact on the ability of these CARTs to expand in culture. Lenalidomide leads to reduction of surface CAR expression in T cells expressing CAR19-HilD, in a dose dependent manner.

Activity of CART19 HilD is comparable to CART19, in the absence of lenalidomide Killing and cytokine secretion by CART19.HilD cells is target cell-specific.

In the killing assay performed here, lenalidomide slightly impairs the ability of CART19-HilD to kill target cells. Under the experimental condition used herein, target cells start dying as soon as CARTs are co-added. The slight shift in cell killing in FIG. 32C is likely due to the fact that the kinetics of cell killing is probably faster than the kinetics of CAR19-HilD degradation.

Lenalidomide interferes with the ability of CART19.HilD, but not CART19, to secrete cytokines.

Example 13: Evaluation of CAR19-HilD In Vivo

This study examines the in vivo activity of T cells expressing CAR19-HilD and its regulation by lenalidomide.

Methods

Xenograft Mouse Model

Female NOD.Cg-Prkdc$^{scid}$ Il2rg$^{tm1Wjl}$/SzJ mice (NSG) mice, 6-8 wk of age, were purchased from Jackson Laboratories Animal studies were carried out under protocols approved by the Institutional Animal Care and Use Committee at NIBR. NSG mice were inoculated with $1.0 \times 10^6$ luciferized Nalm-6 intravenously. Sever days later, CAR-T cells were infused intravenously into tumor-bearing mice; unless otherwise stated, lenalidomide were dosed orally at the same time. Tumor burden was measured by IVIS and was quantified as radiance in the region of interest (ROI), which was generally the area of one mouse. Mice were euthanized upon losing more that 20% of body weight or development of hind limb paralysis. Graft vs. host disease was defined in indicated animals as hair loss, behavioral changes, and clear decrease in health not attributable to Nalm-6 luciferase signal.

CAR Expression Analysis of Splenocytes

Spleens were harvested from the mice used in the in vivo efficacy study described above at the end of the study. Harvested spleen was homogenized into single cell suspension (spleens or spleen-derived cells were not pooled). Cells were washed with RPMI media and frozen in 1 mL freezing media. On the day of staining, cells were thawed in RPMI media with 10% serum. To block the CD16/CD32 receptors, cells were incubated with mouse Fc block (1:100 dilution), at room temperature, for 14 min. The cells were washed and incubated, at 4° C. for 45 min, with 100 µL of biotinylated protein, at a final concentration of 1 µg/mL. Upon PBS wash, cells were incubated at 4° C. with PE conjugated Streptavidin at 1:300 dilution, for 30 min. The cells were then washed twice with PBS and suspended in 100 µL of 2% paraformaldehyde fixation buffer, for 10 min at room temperature. The fixed cells were washed with PBS and suspended in 150 µL PBS. These cells were then acquired in a Fortessa instrument and the results analyzed using Flow Jo software.

Below is the group of mice from which spleen was harvested. Each group had three mice:

Group 1.—CART19.HilD ($5 \times 10^6$)
Group 2.—CART19-HilD ($5 \times 10^6$)+Lena qd
Group 3.—CART19-HilD ($5 \times 10^6$)+Lena bid
Group 4.—CART19.HilD ($5 \times 10^6$)+Lena+5 Day Results Lenalidomide had little effect on Nalm6 growth in vivo (data not shown).

Figure 34:
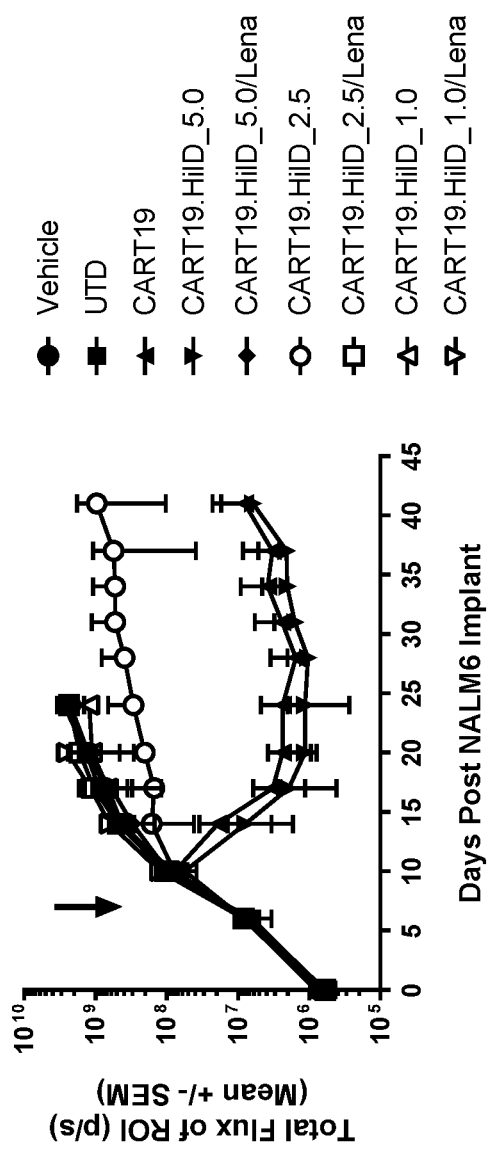
FIG. 34 is a graph showing that lenalidomide abolishes the ability of CART19.HilD to control tumor growth in vivo. Total flux of ROI is plotted against days post Nalm6 implant.
Figure 35:
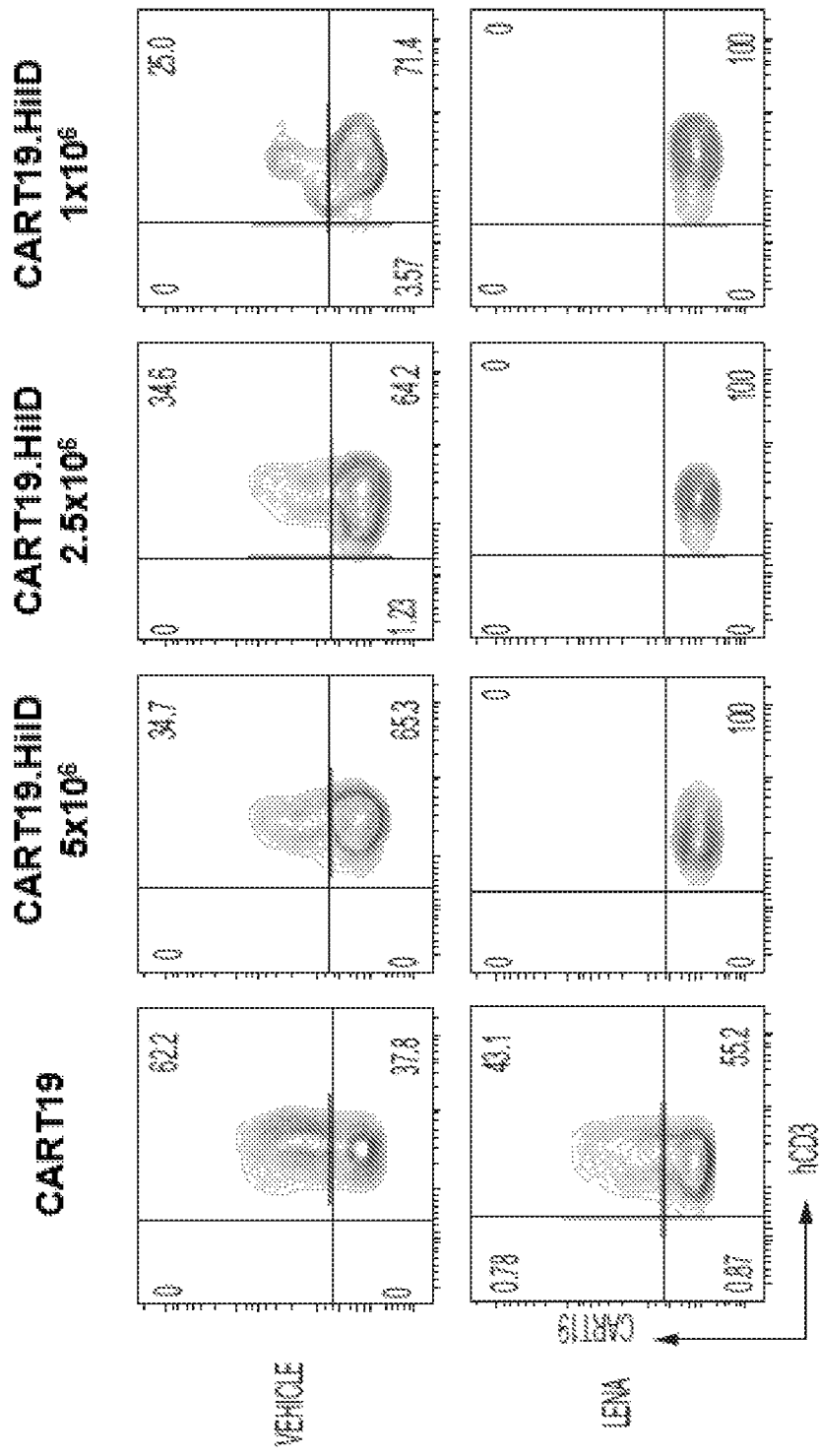
FIG. 35 is a set of flow cytometry plots showing loss of CAR19-HilD expression after lenalidomide treatment.

To determine the therapeutic efficacy of CART19.HilD in vivo, tumor-bearing mice were treated with $5.0 \times 10^6$, $2.5 \times 10^6$ or $1.0 \times 10^6$ CART19.HilD. While $5.0 \times 10^6$ CART19.HilD yielded comparable rates of tumor regression to $2.5 \times 10^6$ CART19, $2.5 \times 10^6$ CART19.HilD could only partially control tumor growth (FIG. 34). $1.0 \times 10^6$ CART19.HilD showed no efficacy (FIG. 34). In addition to dose-dependent activities, which was sustained for >40 d, lenalidomide treatment at 30 mg/kg bid can totally abolish the ability of CART19.HilD to control tumor growth in vivo (FIG. 34). Such results contrast the results obtained in vitro, in the tumor cytolysis assay shown in FIG. 32C. Loss of CART cells in peripheral blood after lenalidomide treatment also confirmed by flow cytometry (FIG. 35).

Figure 36:
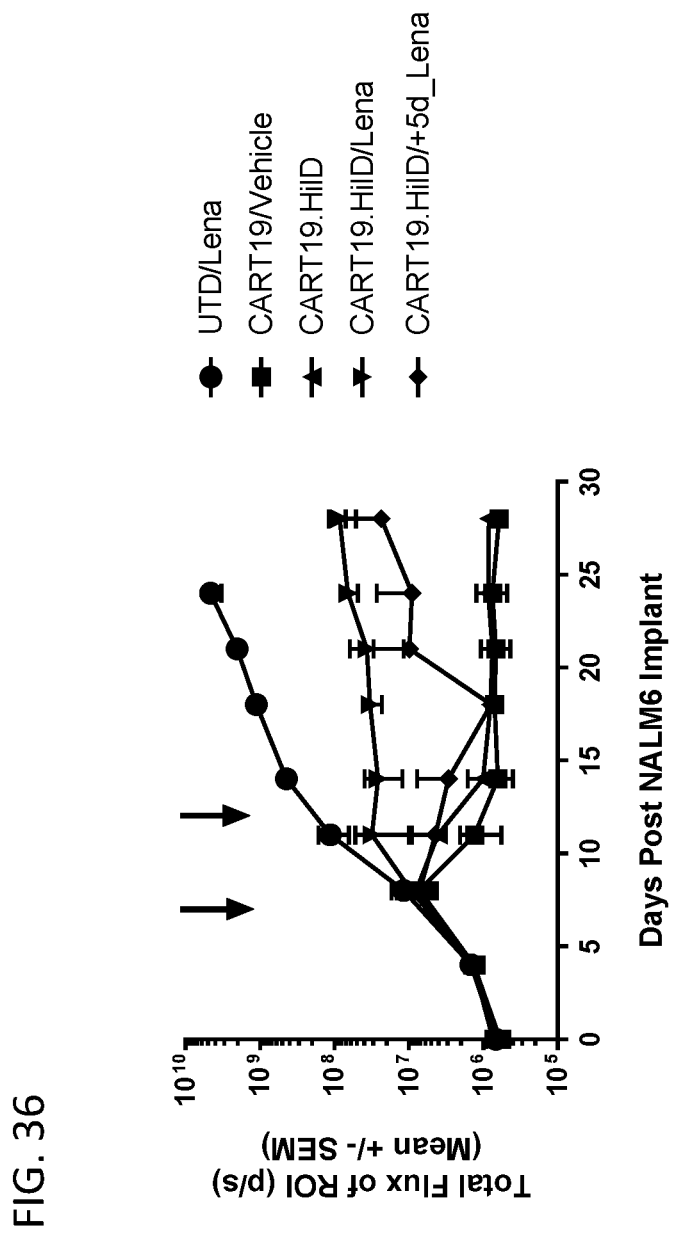
FIG. 36 is a graph showing levels of tumor control in different treatment groups. Total flux of ROI is plotted against days post Nalm6 implant. Early injection of lenalidomide effectively abolished CART expression in mice treated with CART-HilD, leading to absence of tumor control in this group. Later treatment of lenalidomide (day 5 post CART injection) also reduced the function of CARTs as shown by loss of tumor control in this group of mice.

Control of adoptive transfer T cell function in vivo is important to prevent or overcome potential toxicities associated with CART therapy. Thus, it was further investigated whether CART19.HilD activity could be abolished after CART19.HilD had controlled the tumor. A time-course of lenalidomide dose study was performed in Nalm6 tumor-bearing NSG model. Mice dosed with lenalidomide immediately after CART19.HilD transfer lost the ability to control tumor growth in vivo (FIG. 36). Mice dosed with lenalidomide at day 5 after CART19HilD cell adoptive transfer showed tumor relapse a few days after lenalidomide dosing (FIG. 36). Activity of CART19.HilD was comparable to CART19 in the absence of lenalidomide (FIG. 36).

Figure 37A:
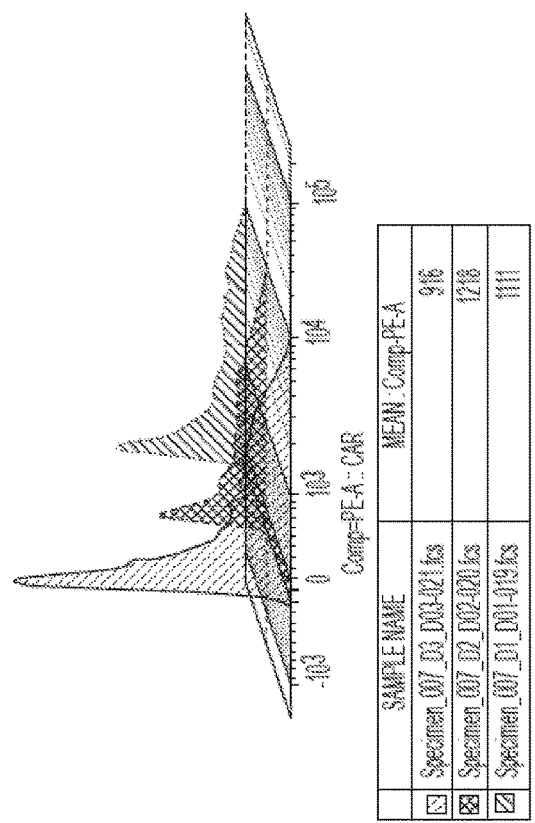
FIGS. 37A, 37B, 37C, 37D, and 37E are graphs analyzing CAR expression in CD3+ cells from splenocytes.
Figure 37B:
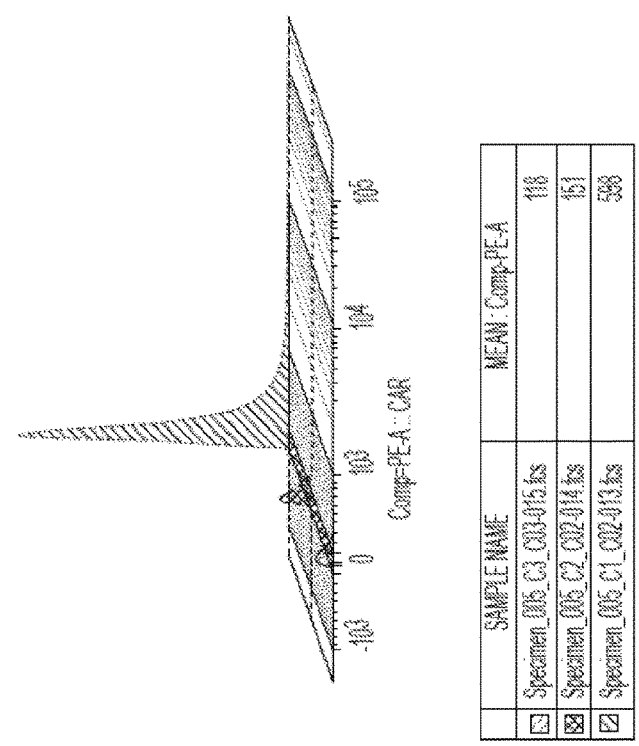
Figure 37C:
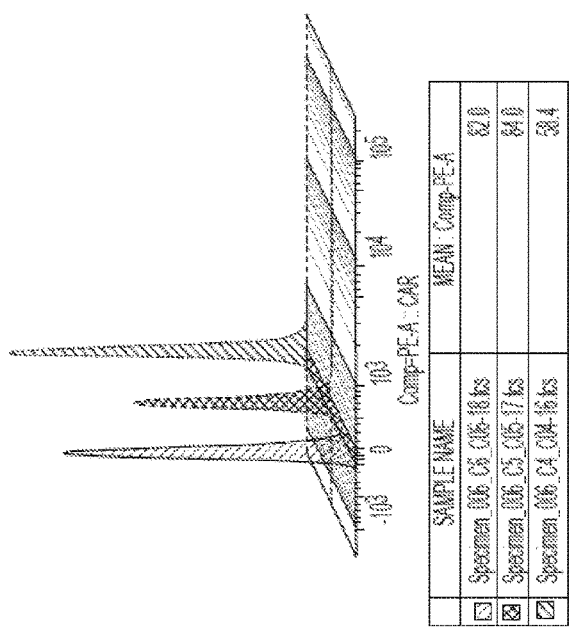
Figure 37D:
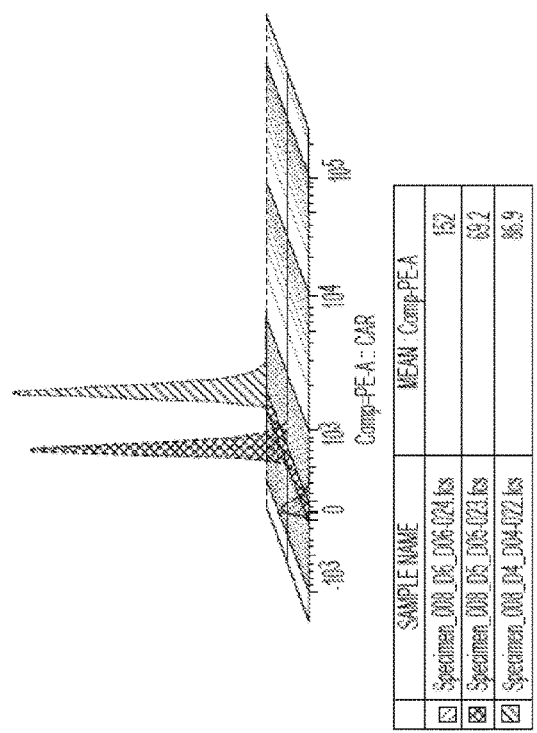
Figure 37E:
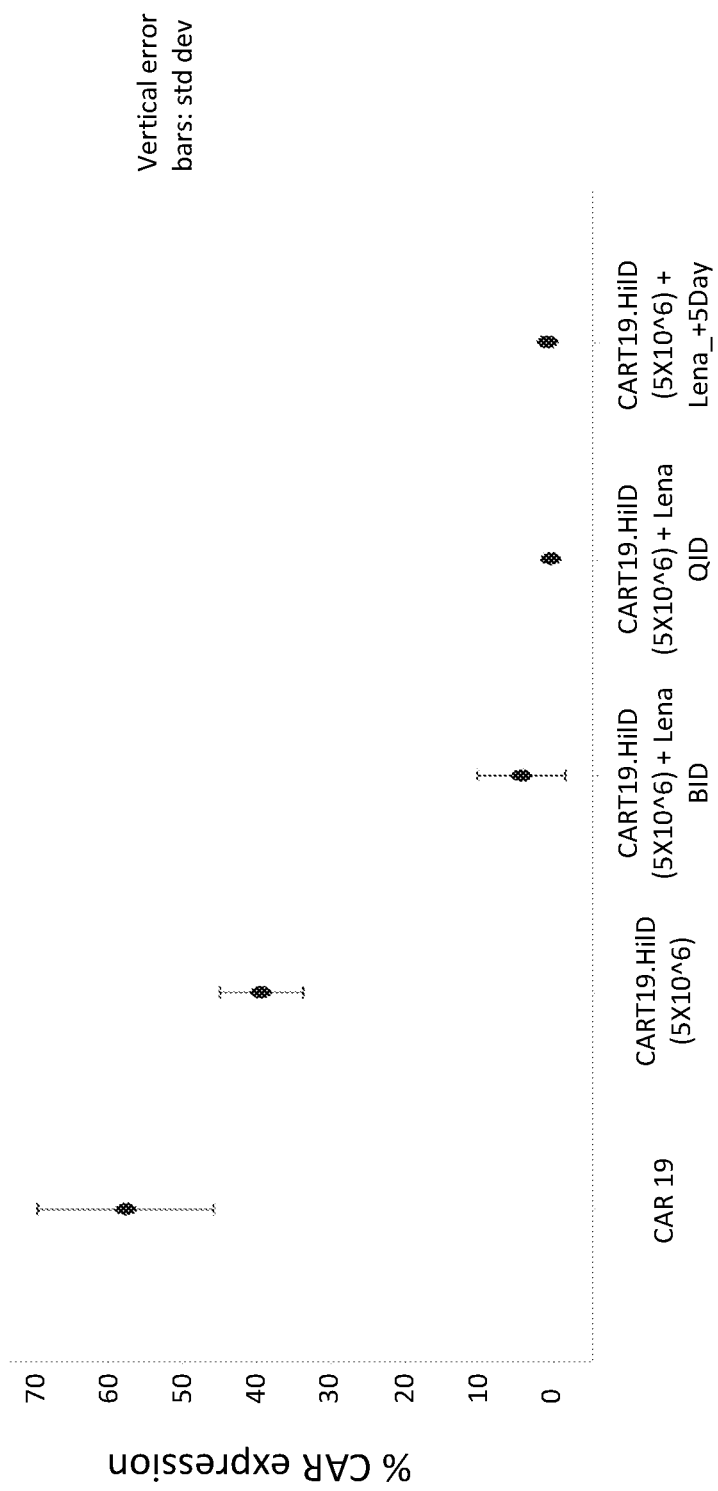

CAR expression in CD3+ cells derived from splenocytes of mice was analyzed. CAR expression in CD3 cells derived from mice treated with T cells expressing CAR19 or CAR19-HilD was comparable (FIG. 37E). All the mice treated with CAR19-HilD and lenalidomide showed significant reduced CAR expression in CD3 positive cells derived from spleen (FIGS. 37B-37E).

Example 14: CARB-Tag Design

The CARBtag is based on an IKZF2-derived hairpin sequence which can be utilized as a degron tag along with Compound I-112 disclosed in Table 29.

IMiD compounds, such as lenalidomide, can induce degradation of IKZF1 and 3, but not IKZF2. The Compound I-112 was identified to specifically degrade IKZF2 but not IKZF1 or IKZF3. Since the HilDtag is based on the IKZF1/IKZF3 hairpin, it can only be degraded by IMiDs. This study explores whether an IKZF2-based hairpin (CARB-tag) can be degraded with the Compound I-112.
Methods
Design:
The initial CARBtag sequence came from the IKZF2 CDS (NM_016260). The N-terminal part of the tag is from H130-S174, and the C-terminal is from A230-D243. The complete amino acid sequence is:

(SEQ ID NO: 109)
HKRSHTGERPFHCNQCGASFTQKGNLLRHIKLHSGEKPFKCPFCSAGQ

VMSHHVPPMED

The above underlined region is the C-terminal portion. Like the HilDtag, the CARBtag is appended to a protein of interest with a 16GS linker (GGGGSGGGGTGGGGSG (SEQ ID NO: 28)). The 16GS-CARBtag DNA was designed with restriction enzyme sites on either side and was synthesized as a gBlock by Integrated DNA technologies. DNA sequence is shown below:

(SEQ ID NO: 110)
CAGTCAGTGGGCCTCGGCGGCCAAGCTTGGCAATCCGGTACTGTTGGT gAAGCCAttCACCatgcataaaaggagtcacactggtgaacgcccctt ccactgtaaccagtgtggagcttcttttactcagaagggcaaccttct gagacacataaagttacactctggagagaagccgttcaaatgtcctttt ctgtagcgctgggcaggtcatgagtcaccatgtacctcctatggaaga tggtggtggcgggagcggaggtggaggcacgggcggtggaggttcggg gAacgttATGCTGGAAATGCTAGAATATAA gBlocks were also designed and synthesized for the entire CAR19(CTL119) with the above CARBtag sequence. DNA sequence is shown below:

(SEQ ID NO: 111)
ccatttcaggtgtcgtgagcggccgctctagagccGAattCGgatcca tggccctccctgtcaccgccctgctgcttccgctggctcttctgctcc acgccgctcggcccgaaattgtgatgacccagtcacccgccactctta gcctttcaccggtgagcgcgcaaccctgtcttgcagagcctcccaag acatctcaaaataccttaattggtatcaacagaagcccggacaggctc ctcgccttctgatctaccacaccagccggctccattctggaatccctg ccaggttcagcggtagcggatctgggaccgactacaccctcactatca gctcactgcagccagaggacttcgctgtctatttctgtcagcaaggga acaccctgccctacacctttggacagggcaccaagctcgagattaaag gtggaggtggcagcggaggaggtgggtccggcggtggaggaagccagg tccaactccaagaaagcggaccgggtcttgtgaagccatcagaaactc tttcactgacttgtactgtgagcggagtgtctctccccgattacgggg tgtcttggatcagacagccaccggggaagggtctggaatggattggag tgatttggggctcAgagactacttactaccaatcatccctcaagtcTc gcgtcaccatctcaaaggacaactctaagaatcaggtgtcactgaaac tgtcatctgtgaccgcagccgacaccgccgtgtactattgcgctaagc attactattatggcgggagctacgcaatggattactggggacagggta ctctggtcaccgtgtccagcaccactaccccagcaccgaggccaccca ccccggctcctaccatcgcctcccagcctctgtccctgcgtccggagg catgtagacccgcagctggtggggccgtgcatacccggggtcttgact tcgcctgcgatatctacatttgggcccctctggctggtacttgcgggg tcctgctgctttcactcgtgatcactcttttactgtaagcgcggtcgga agaagctgctgtacatctttaagcaacccttcatgaggcctgtgcaga ctactcaagaggaggacggctgttcatgccggttcccagaggaggagg aaggcggctgcgaactgcgcgtgaaattcagccgcagcgcagatgctc cagcctaccagcaggggcagaaccagctctacaacgaactcaatcttg gtcggagagaggagtacgacgtgctggacaagcggagaggacgggacc cagaaatgggcgggaagccgcgcagaaagaatccccaagagggcctgt acaacgagctccaaaaggataagatggcagaagcctatagcgagattg gtatgaaagggaacgcagaagaggcaaaggccacgacggactgtacc agggactcagcaccgccaccaaggacacctatgacgctcttcacatgc aggccctgccgcctcggggtggtggcgggagcggaggtggaggcacgg gcggtggaggttcggggcataaaaggagtcacactggtgaacgcccct tccactgtaaccagtgtggagcttcttttactcagaagggcaaccttc tgagacacataaagttacactctggagagaagccgttcaaatgtcctt -continued tctgtagcgctgggcaggtcatgagtcaccatgtacctcctatggaag atTAAgtcgacgcgtAACCCAGCTTTCTTGTACAAAGTGGTTGATATC

CAGCACAGTGGCGGCGCGCCATTCCGCCCCTCTCCCTC.

The immature amino acid sequence of CAR19-16GS-CARBtag is disclosed as SEQ ID NO: 112.

Cloning:

The gBlocks were digested with restriction enzymes as was a mammalian expression vector with a CMV promoter driving either MITF (NM_000248) with a FLAG tag or CD19 (NM_001770) with a V5 tag, generating these final constructs: CD19-16GS-HilD-V5 (a construct described in Example 5), and CARBtag-16GS-MITF-FLAG.

The CTL119-16GS-CARBtag gBlocks were also digested with restriction enzymes but were cloned into a Lentiviral mammalian expression vector containing an EF1a promoter.

Example 15: CARB-Tag Compound I-112 Dose Response Western Blot, Flow Cytometry and JNL CAR19 Functional Assay This study aims to determine the efficacy of the CARB-tag on degrading CAR19 upon dosing Compound I-112.

Methods pNGX_LV_V002 Vector Viral Production:

HEK293T cells (ATCC CRL-3216) were cultured in DMEM with 10% FBS at 37° C. and 5% $CO_2$. Cells were seeded in collagen-coated 6 well plates at 0.75×10^6 cells/well in 2 ml of DMEM, 10% FBS and incubated overnight. The following day the pNGX_LV_V002 vector (0.23 µg) and lentiviral packaging mix DNA (0.28 µg) (Cellecta CPC-K2A) were mixed with 1.5 µl TransIT transfection reagent (Minis MIR2700) in 5541 OptiMEM (Invitrogen 11058021) and added to the plated cells, which were incubated overnight. The following day the media was removed from the cells and 1ml fresh media was added. Cells were incubated for 72 hours. Viral supernatant was harvested from cells and filtered through a 0.45 µM cellulose acetate filter (Corning 430516) and aliquoted and stored at −80° C.

Viral Titer:

Eight-fold dilution of virus was made starting at 1:3 times using RPMI and 10% FCS. 100 µL of SUPT1 cells were plated at 2E5 cells/ml in a flat bottom 96 well plate. 50 µL of diluted virus was added to the cells in duplicates. The plate was incubated at 37° C. in $CO_2$ overnight. 100 µL RPMI media was added to each well and the plate was returned into the incubator. On Day 4 of transduction, the cells were harvested and stained for Protein L and CAR expression was analyzed using Flow Jo.

Cell Treatment:

Jurkat cells containing a NFAT luciferase reporter were infected with either CAR19 or CAR19-CARBtag at a multiplicity of infection (MOI) of 4. Cells were expanded for one week before using. Cells were diluted to 0.5×10^6 in 3 ml total in 6 well dishes. Once cells were plated the samples were treated immediately with 10 µM, 1 µM, 0.1 µM, 0.01 µM and 0.001 µM Compound I-112 and DMSO. All cells were harvested at 24 hours after initial compound treatment for western blotting and flow cytometry analysis.

Western Blot:

Cells were pelleted, washed with PBS, and pellets were lysed with 50 µl RIPA buffer (Boston Bioproducts BP-115D) with protease inhibitors (Roche 04693124001). Lysates were centrifuged, supernatant transferred to new tubes and protein quantities read by Lowry Assay (BioRad 5000111). Each sample was normalized to 30 µg total protein in a 20 µl volume with 4× sample buffer (Thermo Scientific NP0007) and 10× reducing agent (Thermo Scientific NP0009). Samples were run on a 4-12% Bis-Tris acrylamide gel (Thermo Scientific WG1402BOX). The gels were run in duplicate, one for actin and the other for either V5 or CD3Z. Gels were transferred to nitrocellulose membranes and the membranes were incubated overnight in 3% milk in TBS-0.1% Tween-20 with one of the following antibodies: mouse anti-actin (Sigma Aldrich A5441) at 1:10000 dilution; and mouse anti-CD3z (BD 551034) at 1:1000 dilution. Blots were washed the following day in TBS-0.1% Tween-20, placed in 3% milk in TBS-0.1% Tween-20 with 1:10000 sheep-anti-mouse HRP secondary antibody (GE Healthcare NA931) at room temperature for 1 hour, then blots were washed and developed with ECL (Thermo Scientific 34076).

Flow Cytometry:

Cells were harvested in u bottom plate and washed using 1×PBS. The washed cells were stained with 100 µL Biotinylated Protein L (Genscript M00097) diluted at 1:1000× at 1 µg/ml. The primary antibody was incubated at 4° C. for 45 mins. After incubation the cells were washed using PBS. Cells were incubated at 4° C. with PE conjugated Streptavidin (Jackson Lab 016-110-084) at 1:300× dilution for 30 mins. The cells were washed twice with PBS and suspended in 100 µL fixation buffer (2% Paraformaldehyde in PBS) for 10 mins at room temperature. The fixed cells were washed with PBS and suspended in 150 µL PBS. These cells were then acquired using BD LSRF Fortessa cell analyzer. The dead cells were excluded based on the size using the FSC and SSC plot. The live cells were analyzed for their PE CAR expression. Flow cytometry results were gated using unstained JNL parental cell line and 10 k events were recorded for each sample.

Jurkat NFAT Luciferase (JNL) CAR Functional Assay:

CAR19-CARB-tag cells were diluted to 0.5×10^6 in 20 ml RPMI 1640 media (Thermo Fisher Scientific 11875-085) 10% FBS 1× pen/strep. 20 µl (0.5×10^6 cells) of this cell line was plated in a white solid-bottom 384 well plates (Greiner789163-G). Compound I-112 was added to the 384 well plate at an 8-point 1/2-log dilution with 10 µM final top concentration using the Labcyte ECHO acoustic dispenser. Plates were incubated for 15 hours at 37° C., 5% $CO_2$. K562 and Nalm6 cells were re-suspended at 0.5×10^6 cells/ml. Half of the 8-point Compound I-112 treated cells received 20 µl of K562 and the other half received 20 µl of Nalm6 cells. Cells were stored at 37° C., 5% $CO_2$ incubator for eight hours. Samples were then treated with 40 µl (1:1) Bright Glo (Promega E2620) and luminescence was read using Perkin Elmer's Viewlux with a 20 second exposure.

Results

Figure 38A:
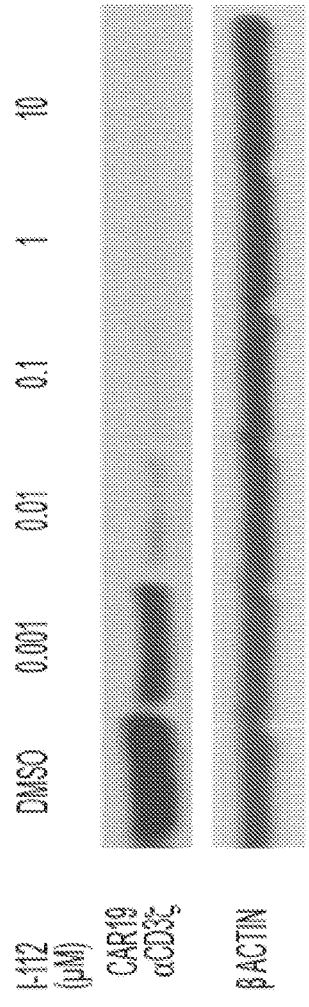
FIGS. 38A, 38B, and 38C are graphs showing impact of Compound I-112 on the expression and activity of CAR19-CARBtag.
Figure 38B:
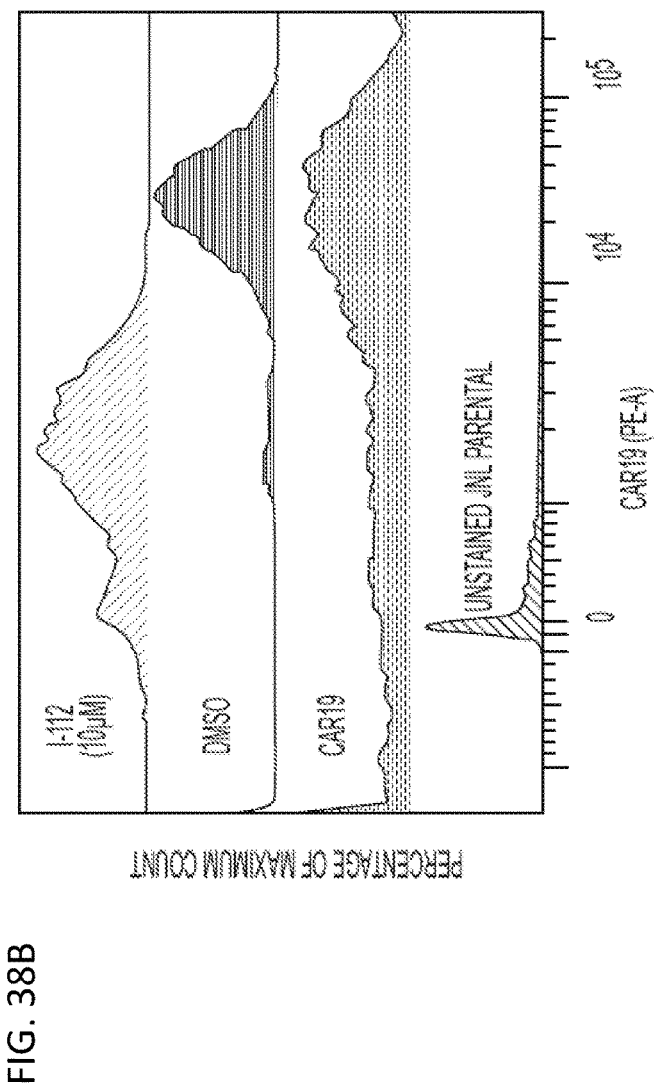
Figure 38C:
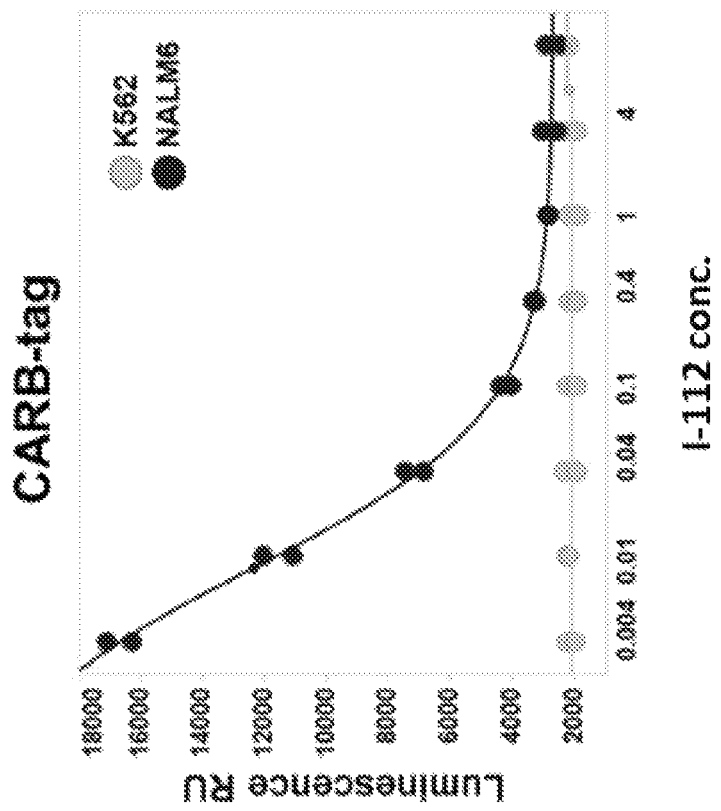

The protein levels of CAR19-CARBtag show a dose-dependent decrease after 24 hours of Compound I-112 treatment (FIG. 38A). Similarly, Compound I-112 treatment also reduced CAR surface expression in JNL CAR19-CARBtag cells (FIG. 38B). As shown in the JNL CAR functional assay described above, CAR19-CARBtag cells only respond to the CD19+ cells Nalm6 and this response is reduced in a dose-dependent manner with increasing amounts of compound treatment (FIG. 38C).

Example 16: Use of the CARB-Tag and HilDtag as an Orthogonal System for Protein Degradation This study aims to determine if CARB-tagged proteins can be degraded in cells upon Compound I-112 treatment.

Also examined is when both a HilD-tagged protein and a CARB-tagged protein are co-expressed, if the expression of each protein can be regulated independently with either lenalidomide treatment (for HilD-tagged protein) or Compound I-112 treatment (for CARB-tagged protein).

Methods

Cellular Gene Expression and Treatment:

HEK293T (ATCC CRL-3216) cells were cultured in DMEM with 10% FBS and pen/strep at 37° C. and 5% $CO_2$. The cells were transfected with either CARBtag-16GS-MITF-FLAG or CARBtag-16GS-MITF-FLAG and CD19-16GS-HilD-V5 using FuGene HD (Promega E2311) using a 3:1 FuGene HD to DNA ratio. Transfected cells were incubated for 24 hours, followed by treatment of either lenalidomide or Compound I-112 in a 4-point log dilution starting at 10 µM final. Cells were treated with the indicated compound for 24 hours and then were prepared for western blot.

Western Blot:

24 hours after compound treatment, the cells were pelleted, washed with PBS, and pellets were lysed with 50 µl RIPA buffer (Boston Bioproducts BP-115D) with protease inhibitors (Roche 04693124001). Lysates were centrifuged, supernatant transferred to new tubes and protein quantities read by Lowry Assay (BioRad 5000111). Each sample was normalized to 30 µg total protein in a 20 µl volume with 4× sample buffer (Thermo Scientific NP0007) and 10× reducing agent (Thermo Scientific NP0009). Samples were run on a 4-12% Bis-Tris acrylamide gel (Thermo Scientific WG1402BOX). The gels were run in triplicate (one for each antibody). Gels were transferred to nitrocellulose membranes and the membranes were incubated overnight in 3% milk in TBS-0.1% Tween-20 with one of the following three antibodies: mouse anti-V5 (Thermo Scientific MA5-15253) at 1:1000 dilution; mouse anti-actin (Sigma Aldrich A5441) at 1:10000 dilution; and mouse anti-FLAG M2 (Sigma F3165) at 1:1000 dilution. Blots were washed the following day in TBS-0.1% Tween-20, then placed in 3% milk in TBS-0.1% Tween-20 with 1:10000 sheep-anti-mouse HRP secondary antibody (GE Healthcare NA931) at room temperature for one-hour, and then blots were washed and developed with ECL (Thermo Scientific 34076).

Results

Figure 39:
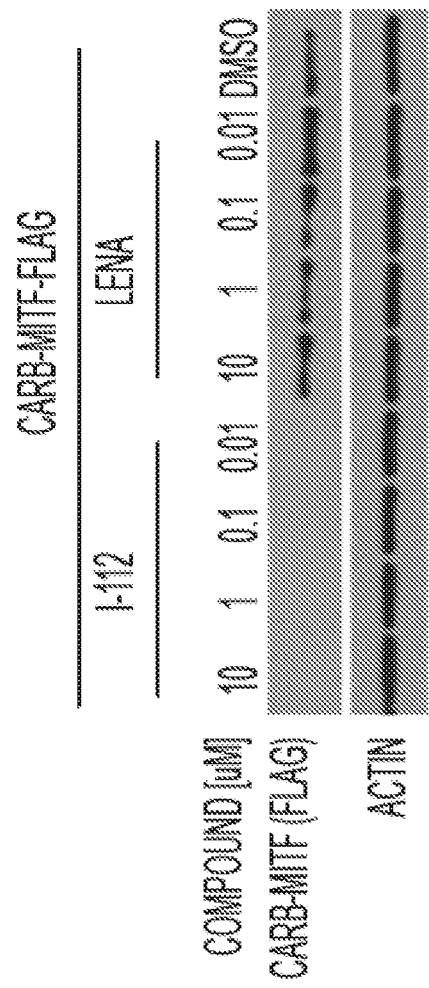
FIG. 39 is western blot of HEK293T cells transiently transfected with CARBtag-MITF-FLAG and treated with either 10 µM, 1 µM, 0.1 µM, or 0.01 µM Compound I-112 or lenalidomide, or DMSO, showing I-112-specific degradation of the CARB-tagged MITF.

CARB-tagged MITF was effectively degraded by Compound I-112, but not lenalidomide (FIG. 39). In contrast, expression of CD19-HilDtag remained constant under different doses of Compound I-112 treatment (data not shown).

Example 17: Characterization of BCMA CAR HilD-Tag Fusion Construct

This study aims to determine if HilD-tag can be utilized to degrade other CARs, e.g., a BCMA CAR. The BCMA CAR-16GS linker-HilD tag sequence is shown below. The HilD tag is single-underlined. The 16GS linker is double-underlined. The signal peptide is shown in italics.

(SEQ ID NO: 1450)
*MALPVTALLLPLALLLHAARP*EVQLVESGGGLVQPGGSLRLSCAVSGF

ALSNHGMSWVRRAPGKGLEWVSGIVYSGSTYYAASVKGRFTISRDNSR

NTLYLQMNSLRPEDTAIYYCSAHGGESDVWGQGTTVTVSSASGGGGSG

GRASGGGGSDIQLTQSPSSLSASVGDRVTITCRASQSISSYLNWYQQK

PGKAPKLLIYAASSLQSGVPSRFSGSGSGTDFTLTISSLQPEDFATYY

CQQSYSTPYTFGQGTKVEIKTTTPAPRPPTPAPTIASQPLSLRPEACR

PAAGGAVHTRGLDFACDIYIWAPLAGTCGVLLLSLVITLYCKRGRKKL

LYIFKQPFMRPVQTTQEEDGCSCRFPEEEEGGCELRVKFSRSADAPAY

QQGQNQLYNELNLGRREEYDVLDKRRGRDPEMGGKPRRKNPQEGLYNE

LQKDKMAEAYSEIGMKGERRRGKGHDGLYQGLSTATKDTYDALHMQAL

PPRGGGGSGGGGTGGGGSGMHKRSHTGERPFQCNQCGASFTQKGNLLR

HIKLHTGEKPFKCHLCNTASAEARHIKAEMG

Methods pELPS Vector Viral Production:

LentiX-293T cells (Clonetech 632180) were cultured in DMEM with 10% FBS at 37° C. and 5% $CO_2$. Cells were seeded in five 15 cm tissue culture plates (BD Biosciences 356451) at 14×10^6 per plate in 25 ml of DMEM, 10% FBS and incubated overnight. The following day 15 µg of the pELPs vector was combined with a lenti-viral packaging mix (18 µg pRSV.REV, 18 µg pMDLg/p.RRE, and 7 µg pVSV-G), 90 µl Lipofectamine 2000 (Invitrogen 11668-019) and 3 ml OptiMEM (Invitrogen 11058021) per 15 cm plate and added to the plated cells. The following day the media was removed and replaced with 15 ml of fresh media. Cells were incubated for 30 hours, then virus was harvested, centrifuged at 500 g for 10 min, and filtered through a 0.45 µM cellulose acetate filter (Corning 430314). The viral supernatant was concentrated using Lenti-X concentrator (Clonetech 611232) at 4° C. overnight, pelleted at 1500 g for 45 min at 4° C., followed by supernatant aspiration and resuspension in DMEM, 10% FBS at $\frac{1}{100}^{th}$ of the initial volume. Virus was aliquoted and stored at −80° C.

Viral Titer:

Eight-fold dilution of virus was made starting at 1:3 times using RPMI and 10% FCS. 100 µL of SUPT1 cells were plated at 2E5 cells/ml in a flat bottom 96 well plate. 50 µL of diluted virus was added to the cells in duplicates. The plate was incubated at 37° C. in $CO_2$ overnight. 100 µL RPMI media was added to each well and the plate was returned into the incubator. On Day 4 of transduction, the cells were harvested, stained for CAR expression and analyzed using Flow Jo.

Cell Treatment:

Jurkat cells containing a NFAT luciferase reporter were infected with BCMACAR-HilDtag at a multiplicity of infection (MOI) of 4. Cells were expanded for one week before using. BCMACAR HilD-tag JNL cells were diluted to 0.5×10^6 in 3 ml total in 6 well dishes. Once the cells were plated, the samples were treated immediately with 10 µM, 1 µM, 0.1 µM, 0.01 µM and 0.001 µM lenalidomide or DMSO. All the cells were harvested at 24 hours after initial lenalidomide treatment for flow cytometry analysis.

Flow Cytometry:

Cells were harvested in u bottom plate and washed using 1×PBS. The washed cells were stained with anti-BCMACAR Alexa flour 647 conjugated antibody (BioLegend #94581) diluted at 1:300×. The primary antibody was incubated at 4° C. for 45 mins. After incubation the cells were washed twice with PBS and suspended in 100 µL Fixation buffer 2% Paraformaldehyde for 10 mins at room temperature. The fixed cells were washed with PBS and suspended in 150 µL PBS. These cells were then acquired using Fortessa instrument. The dead cells were excluded based on the size using the FSC and SSC plot. The live cells were analyzed for their APC CAR expression. Flow cytometry results were gated using unstained JNL parental cell line and 10 k events were recorded for each sample.

Jurkat NFAT Luciferase (JNL) CAR Functional Assay:

The BCMACAR HilD-tag cell line was diluted to 0.5×10^6 in 20 ml RPMI 1640 media (Thermo Fisher Scientific 11875-085) 10% FBS 1× pen/strep. 20 µl (0.5×10^6 cells) of this cell line was plated in a white solid-bottom 384 well plates (Greiner789163-G). Lenalidomide was added to the 384 well plate at an 8-point 1/2-log dilution with 10 µM final top concentration using the Labcyte ECHO acoustic dispenser. Plates were incubated for 15 hours at 37° C., 5% $CO_2$. KMS11 cells were re-suspended at 0.5×10^6 cells/ml. 20 µl of KMS11 cells were added to JNL cells and were stored at 37° C., 5% $CO_2$ incubator for eight hours. Samples were then treated with 40 µl (1:1) Bright Glo (Promega E2620) and luminescence was read using Perkin Elmer Viewlux with a 20 second exposure.

Results

Figure 40A:
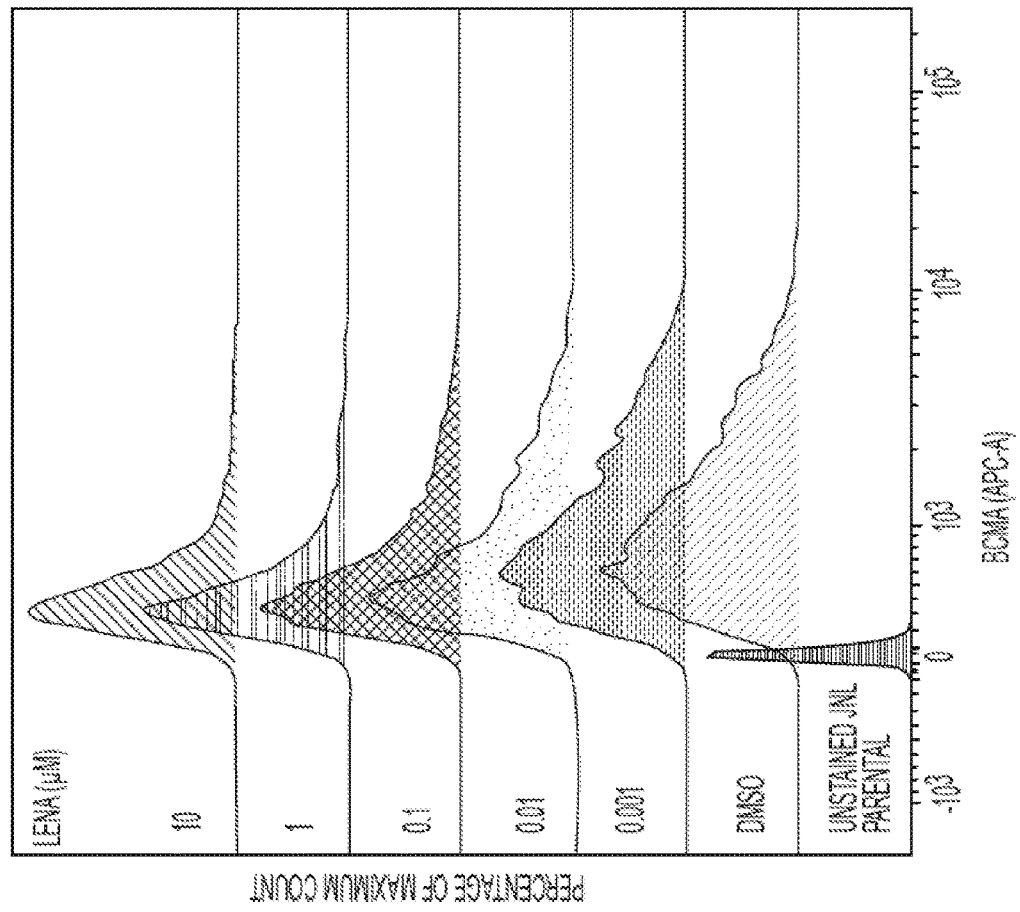
FIGS. 40A and 40B are graphs analyzing impact of lenalidomide on the expression and activity of BCMACAR-HilDtag.
Figure 40B:
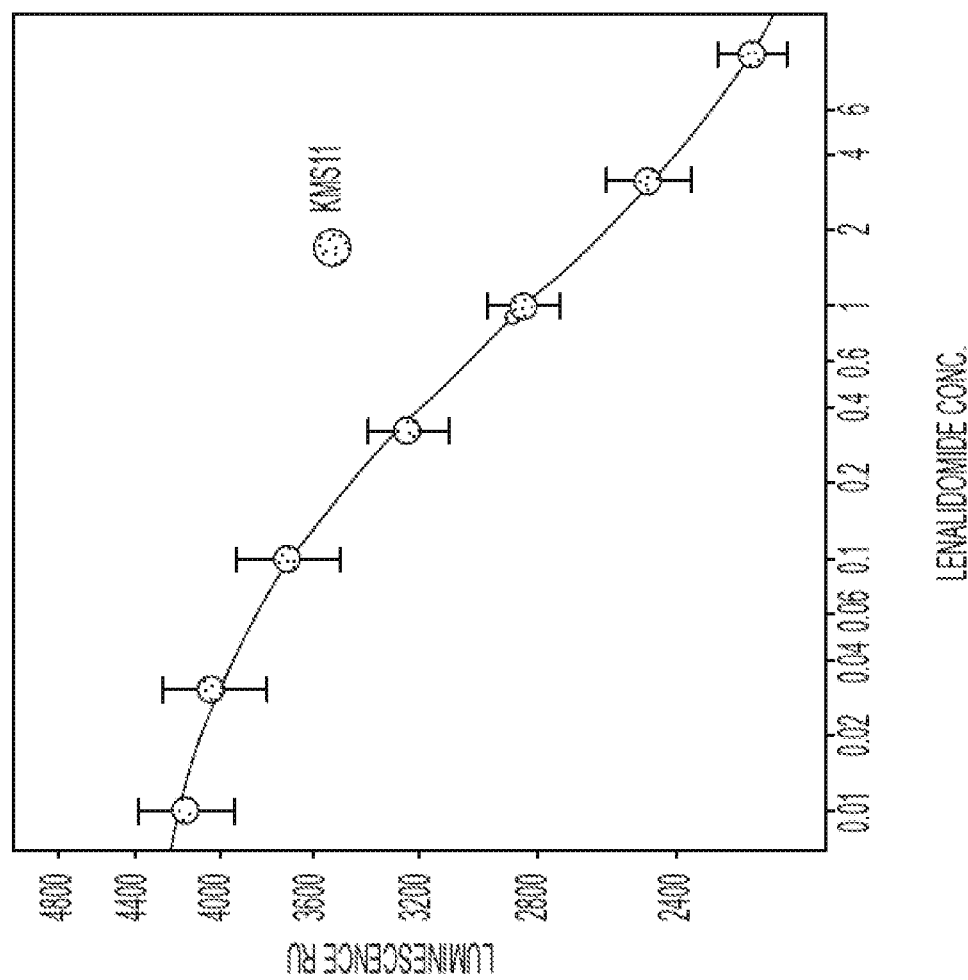

As shown in FIG. 40A, treatment with lenalidomide leads to a dose-dependent reduction of surface expression of BCMACAR HilD-tag. Jurkat NFAT luciferase cells expressing BCMACAR HilD-tag respond to BCMA-expressing KMS11 cells, as evidenced by an increase in luciferase activity, which can be inhibited in a dose-dependent manner with increasing amounts of lenalidomide treatment (FIG. 40B).

Example 18: Synthesis of Exemplary Compounds

The compounds of the present disclosure can be prepared in a number of ways well known to those skilled in the art of organic synthesis. By way of example, compounds of the present disclosure can be synthesized using the methods described below, together with synthetic methods known in the art of synthetic organic chemistry, or variations thereon as appreciated by those skilled in the art. Preferred methods include but are not limited to those methods described below.

Compounds of the present disclosure can be synthesized by following the steps outlined in Scheme I which comprise different sequences of assembling intermediates A-1, A-2, A-3, A-4, A-5, A-5a, A-6a, A-6b, and A-7. Starting materials are either commercially available or made by known procedures in the reported literature or as illustrated. Scheme 1 is meant to provide general guidance in connection with preparing a selection of the compounds of the invention. One skilled in the art would understand that the steps shown in the Scheme can be modified or optimized using general knowledge of organic chemistry to prepare various compounds of the invention.

Scheme 1:

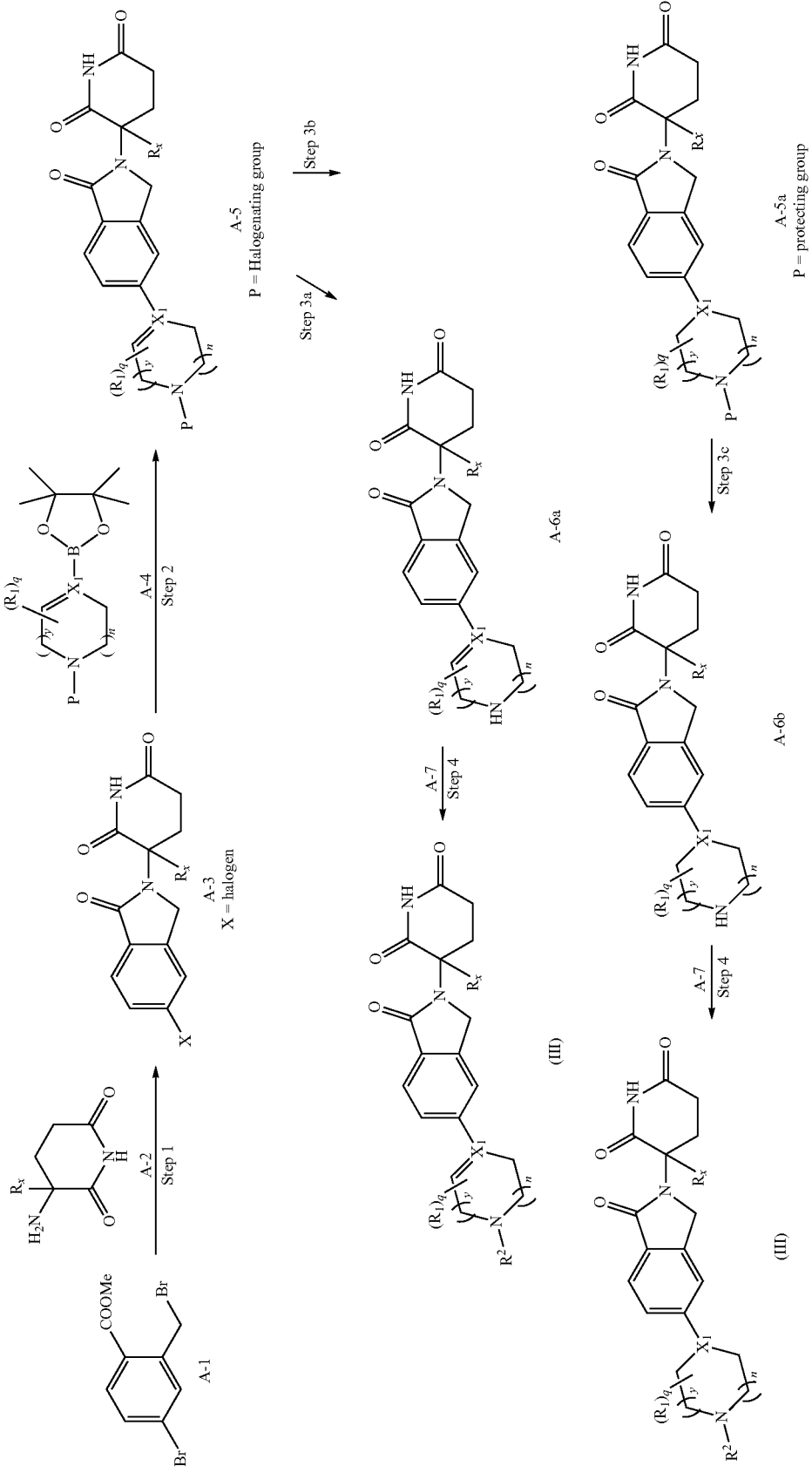

wherein P is an amine protecting group (e.g., tert-butyloxycarbonyl (Boc)) and $X_1$, $R_1$, $R_2$, $R_x$, n, and y are as defined above in Formula (III).

The general way of preparing Compounds of Formula (III), wherein ------ is a double bond and $R_3$ is absent and wherein ------ is a single bond and $R_3$ is hydrogen using intermediates A-1, A-2, A-3, A-4, A-5, A-5a, A-6a, A-6b, and A-7 is outlined in Scheme 1. A-1 may be prepared as reported in U.S. Patent Application US 2009/0142297. Cyclization of A-1 and 3-aminopiperidine-2,6-dione-HCl (A-2) in the presence of a mild base (e.g., potassium carbonate ($K_2CO_3$), cesium carbonate ($Cs_2CO_3$), etc.) in a solvent (e.g., dimethylformamide (DMF)) and optionally at elevated temperature provides A-3 as shown in Step 1. Coupling of A-3 with boronic ester A-4 using a catalyst (e.g., Pd(dppf) $Cl_2 \cdot DCM$), and a base (e.g., cesium carbonate ($Cs_2CO_3$)), in a solvent (e.g., N,N-dimethylformamide (DMF)) at elevated temperature yields A-5. Deprotection of A-5 using a strong acid such as trifluoroacetic acid (TFA) or hydrochloric acid (HCl) in a solvent (e.g., tetrahydrofuran (THF), 1,2,-dichloroethane, dioxane or dichloromethane (DCM)) optionally at elevated temperature to provide A-6a. Reductive amination of A-6a with aldehyde or ketone A-7 provides a compound of Formula (III) wherein ------ is a double bond and $R_3$ is absent. Alternatively, Compounds of Formula (III) wherein ------ is a double bond and $R_3$ is absent can be obtained by alkylation of A-6a with an alkyl halide A-7 in the presence of a base (e.g., $NEt_3$, $Cs_2CO_3$, etc.), in a solvent (e.g., DCM, DMF, etc.), and optionally at elevated temperature.

Hydrogenation of A-5 in the presence of a suitable catalyst (e.g., Pd/C or $PtO_2$) in a solvent (e.g., DMF) and under an atmosphere of hydrogen gas provides A-5a. Deprotection of A-5a using a strong acid such as trifluoroacetic acid (TFA) or hydrochloric acid (HCl) in a solvent (e.g., tetrahydrofuran (THF), 1,2,-dichloroethane, dioxane or dichloromethane (DCM)) optionally at elevated temperature to provide A-6b. Reductive amination of A-6b with aldehyde or ketone A-7 provides a compound of Formula (III) wherein ------ is a single bond and $R_3$ is hydrogen. Alternatively, Compounds of Formula (III) wherein ------ is a single bond and $R_3$ is hydrogen can be obtained by alkylation of A-6b with an alkyl halide A-7 in the presence of a base (e.g., $NEt_3$, $Cs_2CO_3$, etc.), in a solvent (e.g., DCM, DMF, etc.), and optionally at elevated temperature.

A mixture of enantiomers, diastereomers, and cis/trans isomers resulting from the process described above can be separated into their single components by chiral salt technique, chromatography using normal phase, reverse phase or chiral column, depending on the nature of the separation.

Any resulting racemates of compounds of the present disclosure or of intermediates can be resolved into the optical antipodes by known methods, e.g., by separation of the diastereomeric salts thereof, obtained with an optically active acid or base, and liberating the optically active acidic or basic compound. In particular, a basic moiety may thus be employed to resolve the compounds of the present disclosure into their optical antipodes, e.g., by fractional crystallization of a salt formed with an optically active acid, e.g., tartaric acid, dibenzoyl tartaric acid, diacetyl tartaric acid, di-O,O'-p-toluoyl tartaric acid, mandelic acid, malic acid, or camphor-10-sulfonic acid. Racemic compounds of the present disclosure or racemic intermediates can also be resolved by chiral chromatography, e.g., high pressure liquid chromatography (HPLC) using a chiral adsorbent.

Any resulting mixtures of stereoisomers can be separated on the basis of the physicochemical differences of the constituents, into the pure or substantially pure geometric or optical isomers, diastereomers, racemates, for example, by chromatography and/or fractional crystallization.

It should be understood that in the description and formula shown above, the various groups $X_1$, $R_1$, $R_2$, $R_x$, n, and y and other variables are as defined above, except where otherwise indicated. Furthermore, for synthetic purposes, the compounds of Scheme 1 are merely representative with elected radicals to illustrate the general synthetic methodology of the Compounds of Formula (III) as defined herein.

Analytical Methods, Materials, and Instrumentation

Unless otherwise noted, reagents and solvents were used as received from commercial suppliers. Proton nuclear magnetic resonance (NMR) spectra were obtained on either Bruker Avance spectrometer or Varian Oxford 400 MHz spectrometer unless otherwise noted. Spectra are given in ppm (δ) and coupling constants, J, are reported in Hertz. Tetramethylsilane (TMS) was used as an internal standard. Chemical shifts are reported in ppm relative to dimethyl sulfoxide (δ 2.50), methanol (δ 3.31), chloroform (δ 7.26) or other solvent as indicated in NMR spectral data. A small amount of the dry sample (2-5 mg) is dissolved in an appropriate deuterated solvent (1 mL). The chemical names were generated using ChemBioDraw Ultra v12 from CambridgeSoft.

Mass spectra (ESI-MS) were collected using a Waters System (Acquity UPLC and a Micromass ZQ mass spectrometer) or Agilent-1260 Infinity (6120 Quadrupole); all masses reported are the m/z of the protonated parent ions unless recorded otherwise. The sample was dissolved in a suitable solvent such as MeCN, DMSO, or MeOH and was injected directly into the column using an automated sample handler. The analysis is performed on Waters Acquity UPLC system (Column: Waters Acquity UPLC BEH C18 1.7 μm, 2.1×30 mm; Flow rate: 1 mL/min; 55° C. (column temperature); Solvent A: 0.05% formic acid in water, Solvent B: 0.04% formic acid in MeOH; gradient 95% Solvent A from 0 to 0.10 min; 95% Solvent A to 20% Solvent A from 0.10 to 0.50 min; 20% Solvent A to 5% Solvent A from 0.50 to 0.60 min; hold at 5% Solvent A from 0.6 min to 0.8 min; 5% Solvent A to 95% Solvent A from 0.80 to 0.90 min; and hold 95% Solvent A from 0.90 to 1.15 min.

Abbreviations used in the following examples and elsewhere herein are:

| | |
|---|---|
| br | broad |
| d | doublet |
| dd | doublet of doublets |
| ddd | doublet of doublet of doublets |
| dtd | doublet of triplet of doublets |
| $Cs_2CO_3$ | cesium carbonate |
| DCM | dichloromethane |
| DMA | N,N-dimethylacetamide |
| DMAP | 4-dimethylaminopyridine |
| DME | 1,2-Dimethoxyethane |
| DMF | N,N-dimethylformamide |
| DMSO | dimethylsulfoxide |
| $EC_{50}$ | half maximal effective concentration |
| $Et_2O$ | diethyl ether |
| EtOAc | ethyl acetate |
| 4-Et—Py | 4-ethylpyridine |
| HCl | hydrogen chloride |
| HPLC | high performance liquid chromatography |
| h or hr | hour |
| g | gram |
| $IC_{50}$ | half maximal inhibitory concentration |
| $K_2CO_3$ | potassium carbonate |
| KI | potassium iodide |
| $K_3PO_4$ | tripotassium phosphate |

| | |
|---|---|
| KOAc | potassium acetate |
| m | multiplet |
| MeCN | acetonitrile |
| MeOH | methanol |
| mg | milligram |
| MHz | megahertz |
| min | minutes |
| mL | milliliter |
| mmol | millimole |
| M | molar |
| MS | mass spectrometry |
| NaHCO$_3$ | sodium bicarbonate |
| Na$_2$SO$_4$ | sodium sulfate |
| NEt$_3$ | triethylamine |
| NH$_4$OAc | ammonium acetate |
| NiBr$_2$(DME) | nickel (II) bromide ethylene glycol dimethyl ether complex |
| NMR | Nuclear magnetic resonance |
| PdCl$_2$(dppf)$_2$ | [1,1'-Bis (diphenylphosphino) ferrocene]palladium(II) dichloride |
| PdCl$_2$(dppf)•DCM | [1,1'-Bis (diphenylphosphino)ferrocene] dichloropalladium(II), complex with dichloromethane |
| q | quartet |
| qd | quartet of doublets |
| rt | room temperature |
| Rt | retention time |
| s | singlet |
| t | triplet |
| THF | tetrahydrofuran |
| TsCl | 4-toluenesulfonyl chloride |
| tt | triplet of triplets |
| UPLC | ultra-Performance Liquid Chromatography |

Example 18-1: 3-(1-oxo-5-(piperidin-4-yl)isoindolin-2-yl)piperidine-2,6-dione (I-155)

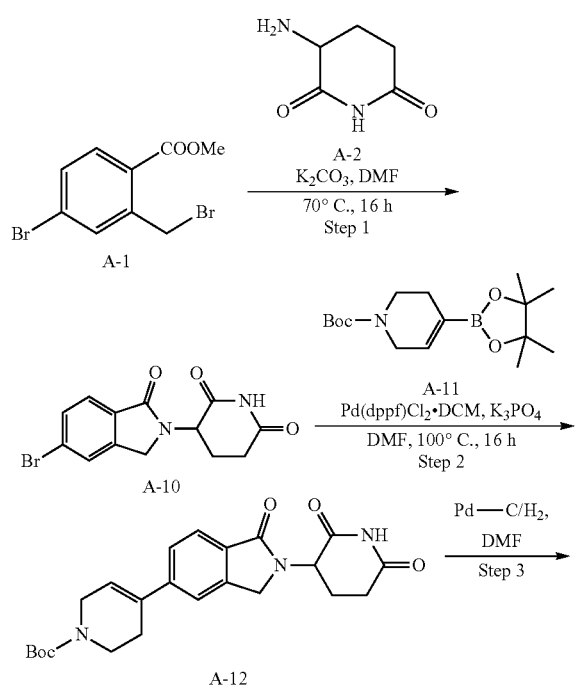

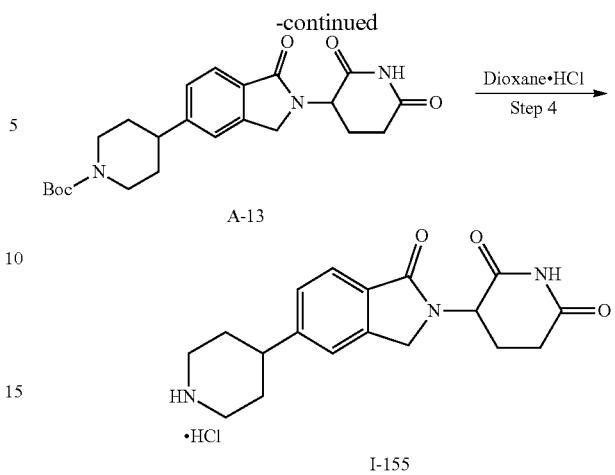

To a stirred solution of methyl 4-bromo-2-(bromomethyl) benzoate (A-1, 15 g, 48.7 mmol) in DMF (150 mL) was added 3-aminopiperidine-2,6-dione-HCl (A-2, 6.9 g, 53.6 mmol) and K$_2$CO$_3$ (20.2 g, 146.1 mmol). The resulting mixture was heated at 70° C. for 16 h after which time the reaction mixture was cooled to room temperature and then concentrated to dryness. Water was then added and the mixture stirred at room temperature for 30 min. The resultant solid was filtered and washed with ether and ethyl acetate and dried under vacuum filtration to afford A-10 (10.6 g, 32.9 mmol, 67% yield). MS [M+H]$^+$=323.0. $^1$H NMR (400 MHz, DMSO-d$_6$) δ 10.99 (s, 1H), 7.91-7.88 (m, 1H), 7.72 (dd, J=8.1, 1.6 Hz, 1H), 7.67 (d, J=8.0 Hz, 1H), 5.11 (dd, J=13.3, 5.1 Hz, 1H), 4.47 (d, J=17.7 Hz, 1H), 4.34 (d, J=17.7 Hz, 1H), 2.98-2.83 (m, 1H), 2.65-2.55 (m, 1H), 2.45-2.29 (m, 1H), 2.01 (dtd, J=12.7, 5.3, 2.3 Hz, 1H).

Step 2. tert-Butyl-4-(2-(2,6-dioxopiperidin-3-yl)-1-oxoisoindolin-5-yl)-3,6-dihydropyridine-1(2H)-carboxylate (A-12)

A solution of A-10 (1.8 g, 5.6 mmol) in DMF (10 mL) in a sealed tube was purged with argon for 5 min prior to addition of 3,6-dihydro-2H-pyridine-1-tert-butoxycarbonyl-4-boronic acid pinacol ester (A-11, 2.2 g, 7.2 mmol), K$_3$PO$_4$ (1.42 g, 6.7 mmol) and Pd(dppf)Cl$_2$·DCM (227 mg, 0.28 mmol). The reaction mixture was again purged with argon for 5 min and then heated at 90° C. for 16 h. After this time the reaction mixture was cooled to room temperature and then concentrated under reduced pressure. Water was added to the residue which was then extracted with EtOAc. The organic layer was washed with brine, dried over Na$_2$SO$_4$, filtered, and then concentrated under a reduced pressure. The crude compound was purified by silica gel chromatography, eluting with 70-80% of EtOAc in hexanes, to afford A-12 as a solid (1.0 g, 2.4 mmol, 42% yield). MS [M+H]$^+$=426.3.

Step 3. tert-Butyl 4-(2-(2,6-dioxopiperidin-3-yl)-1-oxoisoindolin-5-yl)piperidine-1-carboxylate (A-13)

To a stirred solution of A-12 (1.0 g, 2.35 mmol) in DMF (20 mL) was added 10% Pd/C (150 mg) and the mixture was stirred under a hydrogen atmosphere (balloon) at rt for 6 h. The reaction mixture was then filtered through a bed of Celite® filter aid. The filtrate was concentrated under reduced pressure affording A-12 as a solid (0.85 g, 1.97 mmol, 84% yield). MS 1M-tBur=372.3. $^1$H NMR (400 MHz, CDCl$_3$) δ 8.40 (s, 1H), 7.81 (d, J=7.9 Hz, 1H), 7.32

(d, J=8.0 Hz, 1H), 7.29 (s, 1H), 5.22 (dd, J=13.3, 5.1 Hz, 1H), 4.46 (d, J=16.0 Hz, 1H), 4.31 (d, J=16.1 Hz, 1H), 4.27 (d, J=16.2 Hz, 2H), 2.97-2.67 (m, 5H), 2.41-2.26 (m, 1H), 2.23-2.13 (m, 1H), 1.83 (d, J=12.6 Hz, 2H), 1.71-1.55 (m, 2H), 1.48 (s, 9H).

Step 4. 3-(1-oxo-5-(piperidin-4-yl)isoindolin-2-yl)piperidine-2,6-dione hydrochloride (I-155)

To a stirred solution of A-12 (0.85 g, 2.0 mmol) in dioxane (10 mL) was added 4N HCl in dioxane (5.0 mL). The reaction mixture was then stirred at room temperature for 2 h. The reaction mass was concentrated under reduced pressure to afford the HCl salt of desired compound I-155 as a solid (0.65 g, 1.8 mmol, 90% yield, hydrochloride salt). MS [M+H]$^+$=328.3. $^1$H NMR (400 MHz, DMSO-d$_6$): δ 10.99 (s, 1H), 9.28 (s, 1H), 7.70 (d, J=7.8 Hz, 1H), 7.46 (s, 1H), 7.39 (d, J=8.0 Hz, 1H), 5.74 (s, 1H), 5.11 (dd, J=13.3, 5.2 Hz, 1H), 4.46 (d, J=17.3 Hz, 1H), 4.32 (d, J=17.3 Hz, 1H), 3.36 (d, J=11.5 Hz, 2H), 3.10-2.86 (m, 4H), 2.61 (d, J=14.8 Hz, 1H), 2.39 (qd, J=13.2, 4.3 Hz, 1H), 2.14-1.79 (m, 5H).

Example 18-2: 3-(1-oxo-5-(2,2,6,6-tetramethylpiperidin-4-yl)isoindolin-2-yl)piperidine-2,6-dione (I-171)

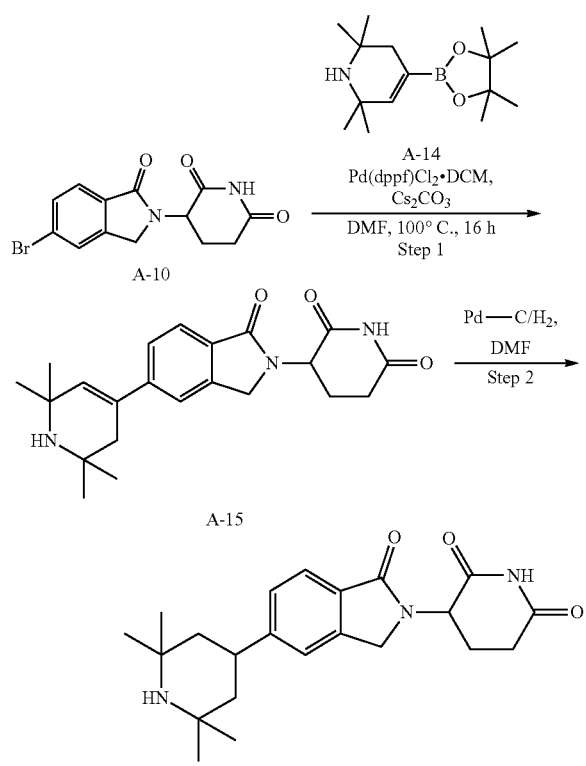

Step 1: 3-(1-oxo-5-(2,2,6,6-tetramethyl-1,2,3,6-tetrahydropyridin-4-yl)isoindolin-2-yl)-piperidine-2,6-dione (A-15)

A stirred solution of A-10 (150 mg, 0.46 mmol) in DMF (5 mL) in a sealed tube was purged with argon for 5 min prior to the addition of 2,2,6,6-tetramethyl-4-(4,4,5,5-tetramethyl-1,3,2-dioxaborolan-2-yl)piperidine (A-14, 185 mg, 0.69 mmol), Cs$_2$CO$_3$ (300 mg, 0.92 mmol) and Pd(dppf)Cl$_2$·DCM (19 mg, 0.02 mmol), and the resulting mixture was again purged with argon for 5 min. The reaction mixture was then heated at 90° C. for 5 h after which time the reaction mixture was cooled to room temperature, water was added, and the mixture was extracted with EtOAc. The organic layer was washed with brine, dried over Na$_2$SO$_4$, filtered, and then concentrated under reduced pressure. The crude material was purified by silica gel chromatography (eluting with 15% MeOH/DCM) to afford A-15 as a solid (35 mg, 0.092 mmol, 20% yield). MS [M+H]$^+$=382.3.

Step 2. 3-(1-oxo-5-(2,2,6,6-tetramethylpiperidin-4-yl)isoindolin-2-yl)piperidine-2,6-dione (I-171)

To a stirred solution of 3-(1-oxo-5-(2,2,6,6-tetramethyl-1,2,3,6-tetrahydropyridin-4-yl)isoindolin-2-yl)piperidine-2,6-dione (A-15, 25 mg, 0.07 mmol) in DMF (2 mL) was added Pd/C (5 mg). The resulting mixture was stirred under a hydrogen atmosphere (balloon) at room temperature for 5 h. The reaction mixture was then filtered through a Celite® filter aid pad and the filtrate was concentrated to dryness. The crude material was purified by reverse phase HPLC (MeCN/H$_2$O with 0.05% formic acid) to afford I-171 as a solid (11 mg, 0.03 mmol, 44% yield). MS [M+H]$^+$=384.4. $^1$H NMR (600 MHz, DMSO-d$_6$): δ11.0 (s, 1H), 8.33-8.32 (m, 1H), 7.68 (d, J=8.0 Hz, 1H), 7.5 (s, 1H), 7.43 (d, J=8.4 Hz, 1H), 5.12 (dd, J=13.2, 4.8 Hz, 1H), 4.36 (d, J=17.4 Hz, 1H), 4.31 (d, J=17.4 Hz, 1H), 2.95-2.90 (m, 1H), 2.43-2.39 (m, 2H), 2.00-1.99 (m, 2H), 1.54-1.50 (m, 2H), 1.52-1.50 (m, 2H), 1.26 (s, 6H), 1.23 (s, 6H).

The following compounds were prepared according to the general protocol presented in Scheme 1 and the examples provided above:

| Compound No. | MS [M + 1]$^+$ |
| --- | --- |
| I-1 | 356.1 |
| I-3 | 382.2 |
| I-4 | 384.1 |
| I-10 | 459.1 |
| I-11 | 424.6 |
| I-13 | 426.2 |
| I-14 | 432.1 |
| I-24 | 454.2 |
| I-26 | 454.1 |
| I-29 | 454.2 |
| I-31 | 443.1 |
| I-32 | 448.2 |
| I-36 | 443.2 |
| I-38 | 443.2 |
| I-39 | 448.4 |
| I-42 | 446.2 |
| I-43 | 458.2 |
| I-45 | 460.5 |
| I-51 | 502.1 |
| I-54 | 502.1 |
| I-56 | 486.2 |
| I-57 | 418.2 |
| I-58 | 419.2 |
| I-59 | 419.2 |
| I-60 | 419.2 |
| I-62 | 432.3 |
| I-63 | 450.2 |
| I-64 | 454.2 |
| I-65 | 445.2 |
| I-66 | 446.5 |
| I-67 | 448.2 |
| I-68 | 450.2 |
| I-69 | 450.2 |
| I-70 | 468.2 |

| Compound No. | MS [M + 1]⁺ |
| --- | --- |
| I-71 | 460.8 |
| I-72 | 461.9 |
| I-73 | 468.2 |
| I-74 | 462.2 |
| I-75 | 460.3 |
| I-76 | 486.2 |
| I-77 | 484.2 |
| I-78 | 487.2 |
| I-79 | 484.2 |
| I-80 | 484.2 |
| I-81 | 472.3 |
| I-82 | 476.2 |
| I-83 | 476.2 |
| I-84 | 474.4 |
| I-86 | 475.2 |
| I-87 | 498.2 |
| I-88 | 490.2 |
| I-89 | 488.3 |
| I-90 | 494.1 |
| I-91 | 484.2 |
| I-93 | 484.2 |
| I-95 | 420.2 |
| I-97 | 452.4 |
| I-101 | 454.2 |
| I-104 | 458.2 |
| I-106 | 486.2 |
| I-107 | 474.3 |
| I-108 | 476.3 |
| I-110 | 486.3 |
| I-112 | 436.4 |
| I-113 | 486.1 |
| I-114 | 469.2 |
| I-115 | 422.2 |
| I-116 | 408.2 |
| I-117 | 422.2 |
| I-118 | 408.1 |
| I-119 | 407.2 |
| I-120 | 408.2 |
| I-121 | 436.2 |
| I-122 | 435.2 |
| I-123 | 434.2 |
| I-124 | 437.2 |
| I-125 | 478.2 |
| I-126 | 459.2 |
| I-127 | 459.2 |
| I-128 | 458.2 |
| I-129 | 436.2 |
| I-130 | 475.2 |
| I-131 | 459.2 |
| I-132 | 459.2 |
| I-134 | 463.2 |
| I-135 | 462.2 |
| I-136 | 457.2 |
| I-137 | 458.2 |
| I-139 | 461.2 |
| I-140 | 458.2 |
| I-141 | 491.2 |
| I-142 | 489.3 |
| I-143 | 481.2 |
| I-145 | 507.2 |
| I-146 | 448.2 |
| I-147 | 505.3 |
| I-148 | 484.2 |
| I-149 | 471.2 |
| I-151 | 485.2 |
| I-152 | 484.2 |
| I-154 | 484.2 |
| I-155 | 328.3 |
| I-156 | 470.3 |
| I-157 | 432.5 |
| I-158 | 432.5 |
| I-159 | 446.1 |
| I-160 | 432.3 |
| I-162 | 432.2 |
| I-163 | 340.3 |
| I-164 | 472.4 |
| I-168 | 472.4 |
| I-169 | 400.3 |
| I-170 | 404.5 |
| I-171 | 384.4. |
| I-172 | 416.4 |
| I-173 | 432.6 |
| I-174 | 446.1 |
| I-175 | 472.4 |
| I-176 | 414.2 |
| I-177 | 442.2 |
| I-178 | 386.2 |
| I-179 | 424.2 |
| I-180 | 461.2 |
| I-181 | 388.0 |
| I-183 | 342.0 |
| I-185 | 446.1 |
| I-187 | 432.1 |
| I-189 | 448.4 |
| I-191 | 384.4 |
| I-198 | 500.2 |
| I-199 | 486.2 |
| I-200 | 475.2 |
| I-201 | 485.2 |
| I-202 | 448.4 |
| I-203 | 472.2 |
| I-204 | 410.2 |
| I-205 | 546.3 |
| I-207 | 533.2 |
| I-208 | 489.2 |
| I-209 | 468.4 |
| I-210 | 426.3 |
| I-211 | 501.2 |
| I-212 | 450.2 |
| I-213 | 492.2 |
| I-214 | 469.2 |
| I-216 | 525.2 |
| I-217 | 444.2 |
| I-219 | 458.2 |
| I-221 | 500.2 |
| I-224 | 486.2 |
| I-225 | 565.2 |
| I-226 | 469.2 |
| I-227 | 531.3 |
| I-228 | 492.2 |
| I-229 | 608.2 |
| I-230 | 432.2 |
| I-231 | 476.2 |
| I-232 | 487.2 |
| I-233 | 567.2 |
| I-234 | 508.2 |
| I-235 | 453.2 |
| I-236 | 567.2 |
| I-237 | 525.2 |
| I-238 | 425.2 |
| I-239 | 470.2 |
| I-240 | 517.2 |
| I-241 | 500.2 |
| I-243 | 554.2 |
| I-244 | 542.2 |
| I-245 | 423.2 |
| I-246 | 409.2 |
| I-247 | 432.2 |
| I-248 | 462.2 |
| I-249 | 448.4 |
| I-251 | 499.2 |
| I-252 | 532.2 |
| I-253 | 410.0 |
| I-254 | 467.2 |
| I-255 | 525.3 |
| I-257 | 499.2 |
| I-258 | 491.3 |
| I-259 | 474.2 |
| I-266 | 492.1 |
| I-276 | 492.2 |
| I-300 | 542.3 |
| I-303 | 454.2 |

Example 18-3: 3-(5-(8-benzyl-8-azabicyclo[3.2.1]octan-3-yl)-1-oxoisoindolin-2-yl)piperidine-2,6-dione HC(O)OH salt (I-265)

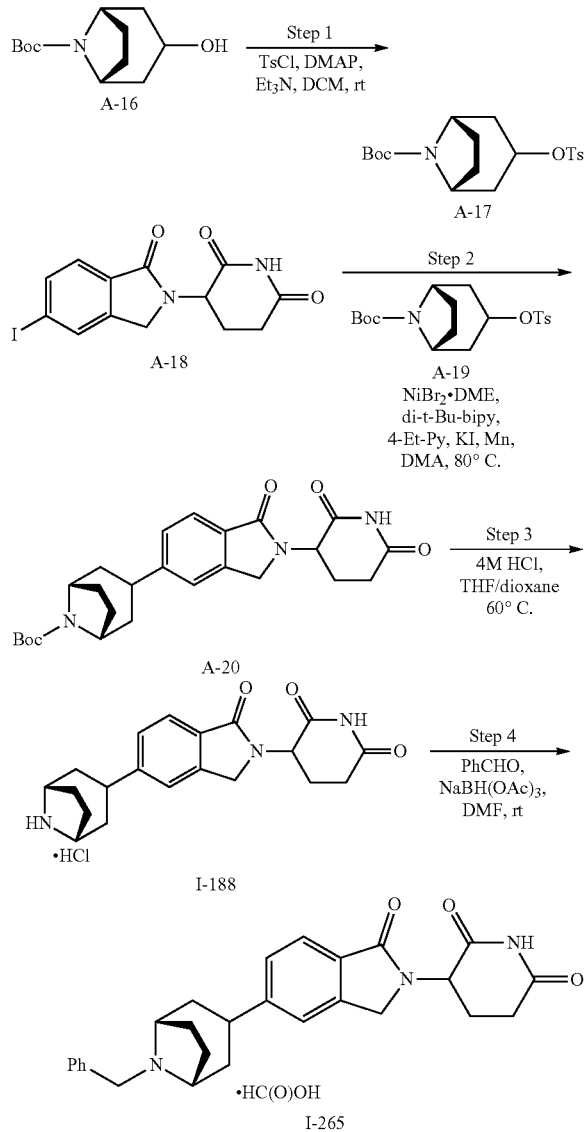

Step 1. tert-butyl 3-(tosyloxy)-8-azabicyclo[3.2.1]octane-8-carboxylate (A-17)

To a stirred solution of 3-hydroxy-8-azabicyclo[3.2.1]octane-8-carboxylate (A-16, 570 mg, 2.51 mmol), Et₃N (0.52 mL, 3.8 mmol), and DMAP (61 mg, 0.50 mmol) in DCM (5 mL) was added TsCl (574 mg, 3.01 mmol) and the resulting mixture was stirred overnight at room temperature. The reaction mixture was then quenched with sat. aq. NaHCO₃ and extracted with DCM (3×). The combined organic phases were dried over Na₂SO₄, filtered, and concentrated, and the crude material was purified by silica gel chromatography eluting with 0% to 40% EtOAc in heptane to afford A-17 (91 mg, 0.22 mmol, 9% yield) as a solid. ¹H NMR (400 MHz, Chloroform-d) δ 7.79 (d, J=8.3 Hz, 2H), 7.36 (d, J=8.5 Hz, 2H), 4.83 (t, J=5.0 Hz, 1H), 4.16 (s, 2H), 2.47 (s, 3H), 2.12-2.02 (m, 4H), 2.00-1.90 (m, 2H), 1.84 (d, J=15.3 Hz, 2H), 1.45 (s, 9H).

Step 2. tert-butyl 3-(2-(2,6-dioxopiperidin-3-yl)-1-oxoisoindolin-5-yl)-8-azabicyclo[3.2.1]-octane-8-carboxylate (A-20)

To a stirred suspension of A-18 (56 mg, 0.15 mmol), 56b (69 mg, 0.18 mmol), NiBr₂(DME) (4.7 mg, 0.015 mmol), 4,4'-di-tert-butyl-2,2'-dipyridyl (4.1 mg, 0.015 mmol), KI (25 mg, 0.15 mmol), and manganese powder (17 mg, 0.30 mmol) in DMA (0.7 mL) under an atmosphere of nitrogen was added 4-ethylpyridine (0.017 mL, 0.15 mmol) and the resulting mixture was stirred vigorously at 80° C. for 4 hours. The reaction mixture was then diluted with MeCN and filtered through a pad of Celite® filter aid eluting with MeCN. The filtrate was concentrated to dryness by azeotroping with heptane. The crude material was purified by silica gel chromatography eluting with 0% to 5% MeOH in DCM to afford A-20 (38.4 mg, 0.085 mmol, 56% yield) as a solid. MS [M+H]⁺=454.5. NMR (400 MHz, Chloroform-d) δ 8.58 (s, 1H), 7.80 (dd, J=7.9, 0.6 Hz, 1H), 7.32 (dd, J=7.9, 1.4 Hz, 1H), 7.29 (s, 1H), 5.23 (dd, J=13.3, 5.1 Hz, 1H), 4.46 (d, J=16.0 Hz, 1H), 4.39-4.24 (m, 3H), 3.20 (tt, J=11.8, 5.2 Hz, 1H), 2.94-2.74 (m, 2H), 2.34 (qd, J=12.8, 5.6 Hz, 1H), 2.23-2.13 (m, 1H), 2.09-2.02 (m, 2H), 1.90 (t, J=12.9 Hz, 2H), 1.80 (q, J=8.0, 6.6, 6.2 Hz, 2H), 1.76-1.69 (m, 2H), 1.51 (s, 9H).

Step 3. 3-(5-(8-azabicyclo[3.2.1]octan-3-yl)-1-oxoisoindolin-2-yl)piperidine-2,6-dione hydrochloride (I-188)

To a stirred solution of A-20 (38 mg, 0.084 mmol) in THF (1 mL) was added 4 M HCl in dioxane (0.7 mL, 2.8 mmol) and the resulting mixture was stirred for 3 hours at 60° C. Formation of white precipitate was observed. The reaction mixture was then diluted with Et₂O and filtered. The precipitate was washed with Et₂O and then dried to afford the hydrochloride salt of I-188 (31.9 mg, 0.082 mmol, 98%) as a solid. MS [M+H]⁺=354.3. ¹H NMR (400 MHz, DMSO-d₆) δ 10.98 (s, 1H), 9.18 (s, 1H), 7.69 (dd, J=7.8, 2.3 Hz, 1H), 7.56 (s, 1H), 7.50 (d, J=7.9 Hz, 1H), 5.10 (ddd, J=13.2, 5.2, 2.1 Hz, 1H), 4.45 (d, J=18.1 Hz, 1H), 4.30 (dd, J=17.3, 2.2 Hz, 1H), 4.03 (s, 2H), 3.26-3.21 (m, 1H), 2.92 (tt, J=14.0, 5.2 Hz, 1H), 2.67-2.54 (m, 1H), 2.45-2.31 (m, 1H), 2.17 (t, J=13.1 Hz, 2H), 2.09-1.92 (m, 5H), 1.89-1.73 (m, 2H).

Step 4. 3-(5-(8-benzyl-8-azabicyclo[3.2.1]octan-3-yl)-1-oxoisoindolin-2-yl)piperidine-2,6-dione HC(O)OH salt (I-265)

To a stirred solution of I-188 (20 mg, 0.051 mmol) and benzaldehyde (0.016 mL, 0.154 mmol) in DMF (1 mL) was added sodium triacetoxyborohydride (33 mg, 0.15 mmol) in one portion and the resulting mixture was stirred vigorously at room temperature overnight. One drop of HCOOH was then added and the reaction mixture was concentrated under reduced pressure. The crude material was purified by reverse phase HPLC (eluting with MeCN/H₂O with 0.1% formic acid) and the product lyophilized to afford the formate salt of I-265 (15.0 mg, 0.031 mmol, 60% yield) as a solid. MS [M+H]⁺=444.3. ¹H NMR (400 MHz, DMSO-d₆) δ 10.98 (s, 1H), 8.25 (s, 1H), 7.64 (d, J=7.9 Hz, 1H), 7.52 (s, 1H), 7.42 (d, J=8.1 Hz, 3H), 7.35-7.31 (m, 2H), 7.24 (t, J=7.3 Hz, 1H), 5.10 (dd, J=13.0, 5.0 Hz, 1H), 4.42 (d, J=17.2 Hz, 1H), 4.29 (d, J=17.1 Hz, 1H), 3.61 (s, 2H), 3.25 (s, 2H), 3.13-3.01 (m, 1H), 2.91 (ddd, J=17.9, 13.2, 5.3 Hz, 1H), 2.59 (d, J=17.0 Hz, 1H), 2.46-2.31 (m, 1H), 2.14-1.94 (m, 3H), 1.85 (t, J=12.4 Hz, 2H), 1.76 (d, J=7.8 Hz, 2H), 1.63 (d, J=12.7 Hz, 2H).

Compound I-260 was synthesized according to the route described in Example 18-3 (MS [M+H]$^+$=404.2).

Example 18-4: Diastereomers of 3-(5-(1-benzylazepan-4-yl)-1-oxoisoindolin-2-yl)piperidine-2,6-dione (I-190) and (I-273)

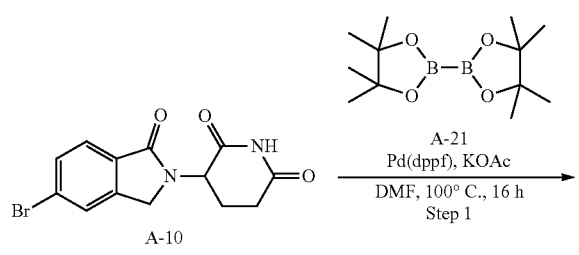

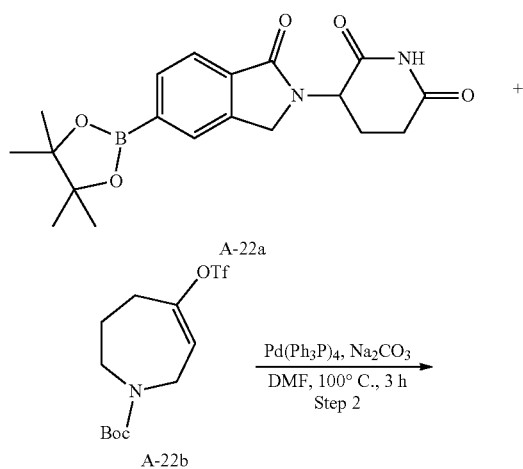

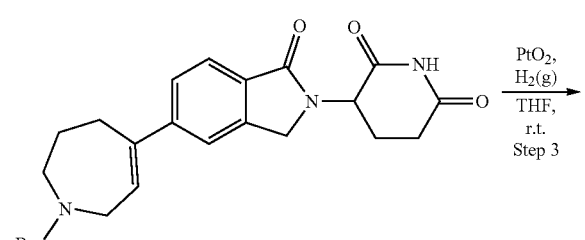

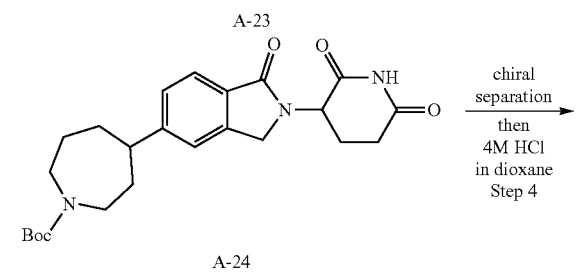

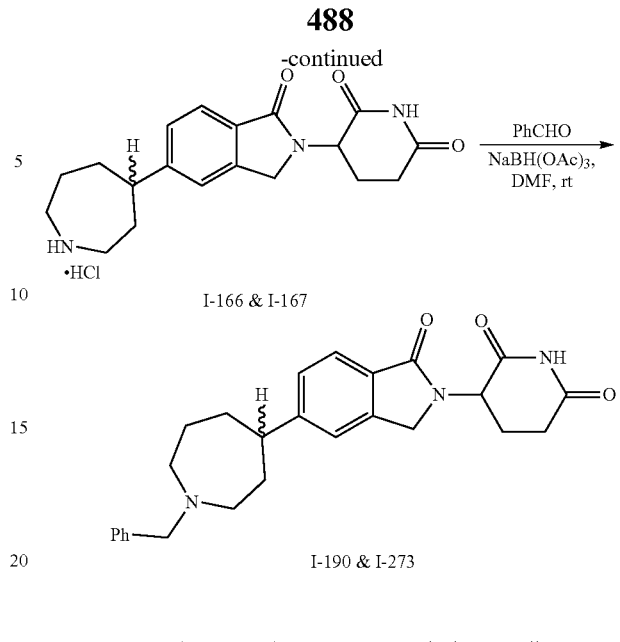

Step 1: 3-(1-oxo-5-(4,4,5,5-tetramethyl-1,3,2-dioxaborolan-2-yl)isoindolin-2-yl)piperidine-2,6-dione (A-22a)

To a stirred solution of A-10 (3.0 g, 9.28 mmol) in DMF (20 mL) in a sealed tube was added bis(pinacolato)diboron (A-21, 2.6 g, 10.2 mmol), KOAc (2.37 g, 27.9 mmol), and PdCl$_2$(dppf)$_2$ (0.22 g, 0.28 mmol). The reaction mixture was purged with argon for 5 min, sealed, and then heated at 100° C. for 16 h. Water was added to the reaction mixture and stirred at room temperature for 15 min. The solid was precipitated, filtered, and dried under vacuum to afford A-22a as a solid (2.3 g, 6.2 mmol, 66% yield). MS [M+H]$^+$= 371.0.

Step 2: tert-butyl 5-(2-(2,6-dioxopiperidin-3-yl)-1-oxoisoindolin-5-yl)-2,3,4,7-tetrahydro-1H-azepine-1-carboxylate (A-23)

tert-Butyl-5-(((trifluoromethyl)sulfonyl)oxy)-2,3,4,7-tetrahydro-1H-azepine-1-carboxylate A-22b was prepared as reported in PCT Application Publication No. 2007/111904.

To a stirred solution of A-22a (1.0 g, 2.70 mmol) in DMF (10.0 mL) in a sealed tube was added tert-butyl 5-(((trifluoromethyl) sulfonyl)oxy)-2,3,4,7-tetrahydro-1H-azepine-1-carboxylate (A-22b, 1.19 g, 3.24 mmol), Pd(PPh$_3$)$_4$ (0.16 g, 0.13 mmol), and Na$_2$CO$_3$ (0.85 g, 8.10 mmol). The mixture was purged with argon for 5 min and then sealed and heated at 100° C. for 3 h. After this time, the reaction was cooled and water added prior to extraction with EtOAc. The organic layer was dried over Na$_2$SO$_4$, filtered, concentrated under reduced pressure, and purified by silica gel chromatography (eluting with 60-70% EtOAc/hexanes) to afford A-23 as a solid (350 mg, 0.796 mmol, 29% yield). MS [M+H]$^+$=440.0.

Step 3: tert-butyl 4-(2-(2,6-dioxopiperidin-3-yl)-1-oxoisoindolin-5-yl)azepane-1-carboxylate (A-24)

To a stirred solution of A-23 (0.35 g, 0.80 mmol) in THF (10 mL) was added PtO$_2$ (100 mg). The mixture was stirred under hydrogen balloon for 5 h. The reaction mixture was then filtered on a bed of Celite® filter aid and then concentrated under reduced pressure. The resulting residue was purified by silica gel chromatography (eluting with 40-50%

EtOAc/hexane) to afford A-24 as a solid consisting of a mixture of diastereomers (0.31 g, 0.70 mmol, 88% yield). MS [M+H]⁺=442.0.

Step 4a: chiral separation of tert-butyl 4-(2-(2,6-dioxopiperidin-3-yl)-1-oxoisoindolin-5-yl)azepane-1-carboxylate (A-24)

Chiral separation of A-24 (350 mg) was performed using a Kinetex (150 mm×21 mm), 5.0µ column, with eluent consisting of mobile phase A=0.05% TFA in water; mobile phase B=acetonitrile and a flow rate of 20 mL/min at 25° C. with 20-70% mobile phase B: mobile phase A over 20 min. Under these conditions two compounds were isolated A-24 (peak 1) Rt=11.64 min and A-24 (peak 2) Rt=17.41 min). The fractions corresponding to peak 1 and peak 2 were collected and concentrated under reduced pressure then neutralized with aqueous saturated NaHCO₃ solution prior to extraction with DCM. The organic layers were combined, dried over Na₂SO₄, filtered, and concentrated to dryness affording peak 1 (50 mg) and peak 2 (45 mg) as white solids. MS [M+H]⁺=442.0.

Step 4b: 3-(5-(azepan-4-yl)-1-oxoisoindolin-2-yl) piperidine-2,6-dione (I-166 & I-167)

To a stirred solution of A-24 (peak 1) (50 mg, 0.113 mmol) in dioxane (2.0 mL) at 0° C. was added 4M HCl in dioxane (0.5 mL). The reaction was then allowed to stir and warm up to room temperature over 2 h. The reaction mixture was then concentrated under reduced pressure to afford diastereomer A (40 mg, 0.106 mmol, 94%, hydrochloride salt). MS [M+H]⁺=342.3. ¹H NMR (CD₃OD, 300 MHz): δ 7.74 (d, J=8.1 Hz, 1H), 7.49 (1H, s), 7.43 (d, J=8.4 Hz, 1H), 5.14 (dd, J=13.5, 5.1 Hz, 1H), 4.48-4.46 (m, 2H), 3.74-3.71 (m, 1H), 3.68-3.63 (m, 2H), 3.59-3.55 (m, 1H), 3.44-3.37 (m, 2H), 3.02 (m, 1H), 2.90-2.78 (m, 2H), 2.51-2.47 (m, 1H), 2.16-2.08 (m, 5H), 2.00-1.80 (m, 2H).

To a stirred solution of A-24 (peak 2) (40 mg, 0.091 mmol) in dioxane (2.0 mL) at 0° C. was added 4M HCl in dioxane (0.5 mL). The reaction was then allowed to stir and warm up to rt over 2 h. The reaction mixture was then concentrated under reduced pressure to afford diastereomer B (30 mg, 0.079 mmol, 87% yield, hydrochloride salt). MS [M+H]⁺=342.4. ¹H NMR (CD₃OD, 300 MHz): δ 7.74 (d, J=7.5 Hz, 1H), 7.49 (s, 1H), 7.42 (d, J=7.8 Hz, 1H), 5.15 (dd, J=13.5, 5.1 Hz, 1H), 4.47-4.45 (m, 2H), 3.74-3.71 (m, 1H), 3.67-3.62 (m, 3H), 3.58-3.55 (m, 1H), 3.43-3.38 (m, 2H), 3.02 (m, 1H), 2.90-2.78 (m, 2H), 2.51-2.48 (m, 1H), 2.17-2.08 (m, 5H), 2.09-1.87 (m, 1H).

Step 5. Diastereomers of 3-(5-(1-benzylazepan-4-yl)-1-oxoisoindolin-2-yl)piperidine-2,6-dione (I-190 and I-273)

Compound I-190 was prepared from I-166 (80 mg, 0.21 mmol) and benzaldehyde (27 mg, 0.25 mmol) via reductive amination. After complete consumption of starting materials, the crude reaction mixture was concentrated under reduced pressure and sat. aq. NaHCO₃ was added. The resulting mixture was extracted with DCM and the organic layer was dried over Na₂SO₄, filtered, and concentrated to dryness. The resulting solid was washed with ether (5 mL) and EtOAc (0.1 mL) affording I-190 as a solid (55 mg, 0.13 mmol, 60% yield). Absolute stereochemistry is not known and was arbitrarily assigned. MS [M+H]⁺=439.1. ¹H NMR (CD₃OD, 600 MHz): δ 7.69 (d, J=5.2 Hz, 1H), 7.44 (s, 1H), 7.39-7.36 (m, 3H), 7.32-7.30 (m, 2H), 7.26-7.24 (m, 1H), 5.12 (dd, J=8.8, 3.2 Hz, 1H), 4.47 (d, J=11.6 Hz, 1H), 4.41 (d, J=11.2 Hz, 1H), 3.71 (2H, s), 2.98-2.97 (m, 1H), 2.92-2.86 (m, 2H), 2.80-2.74 (m, 4H), 2.47-2.45 (m, 1H), 2.16-2.14 (m, 1H), 1.94-1.84 (m, 1H), 1.80 (m, 1H).

Compound I-273 was prepared from I-167 (80 mg, 0.21 mmol) and benzaldehyde (27 mg, 0.25 mmol) in a similar manner as describe above for I-190. I-273 was isolated as a solid (55 mg, 0.13 mmol, 60% yield). Absolute stereochemistry is not known and was arbitrarily assigned. MS [M+H]⁺= 439.1. ¹H NMR (DMSO-d₆, 400 MHz): δ 11.0 (1H, s), 7.62 (d, J=5.2 Hz, 1H), 7.46 (s, 1H), 7.38-7.32 (m, 5H), 7.24-7.23 (m, 1H), 5.09 (dd, J=8.8, 3.6 Hz, 1H), 4.31 (d, J=11.6 Hz, 1H), 4.28 (d, J=11.6 Hz, 1H), 3.65 (d, J=9.1 Hz, 1H), 3.63 (d, J=9.2 Hz, 1H), 2.96-2.88 (m, 2H), 2.76-2.69 (m, 1H), 2.67-2.62 (m, 3H), 2.61-2.50 (m, 2H), 2.46-2.36 (m, 3H), 1.99 (m, 2H), 1.82 (m, 2H).

Example 18-5: 3-(5-(1-benzyl-2-oxo-1,2-dihydro-pyridin-4-yl)-1-oxoisoindolin-2-yl)-piperidine-2,6-dione (I-192)

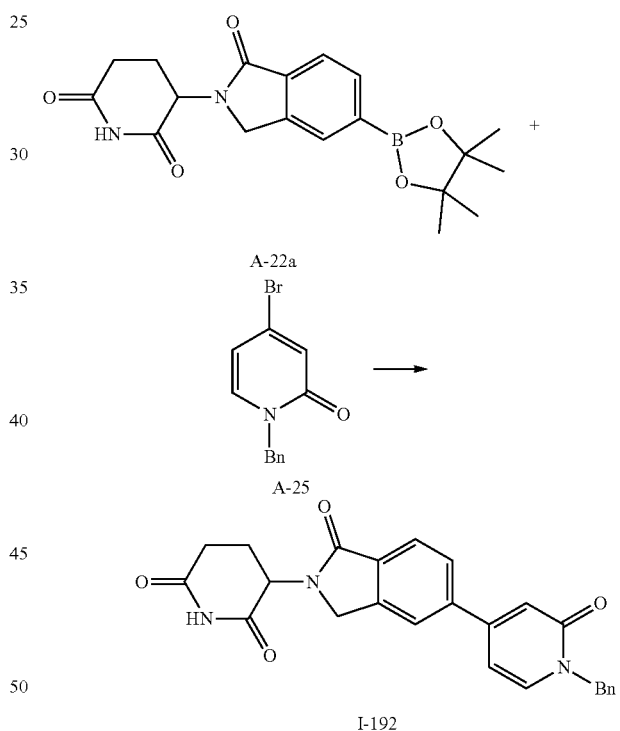

To a stirred suspension of A-22a (500 mg, 1.35 mmol), A-25 (428 mg, 1.62 mmol), and K2CO₃ in DMF (5 mL) was added PdCl₂(dppf)·DCM (55 mg, 0.07 mmol) and the resulting mixture was sparged with argon for 10 min and then stirred at 130° C. for 90 min. After complete consumption of the starting material, the reaction mixture was quenched with ice-cold water and extracted with EtOAc (3×50 mL). The combined organic extracts were washed with brine, dried over Na₂SO₄, and concentrated under reduced pressure. The crude material was purified by silica gel chromatography eluting with 5% MeOH in DCM to afford I-192 as a solid (20 mg, 0.46 mmol, 35% yield). MS [M+H]⁺=427.8. ¹H NMR (400 MHz, DMSO-d₆): δ 10.98 (s, 1H), 7.94 (s, 1H), 7.90 (d, J=7.6 Hz, 1H), 7.80-7.76 (m, 2H), 7.33-7.25

(m, 5H), 6.76 (d, J=2.0 Hz, 1H), 6.64 (dd, J=7.2, 2.0 Hz, 1H), 5.12 (s, 2H), 5.12-5.08 (m, 1H), 4.48 (d, J=17.2 Hz, 1H), 4.36 (d, J=17.2 Hz, 1H), 2.80-2.75 (m, 1H), 2.60-2.53 (m, 1H), 2.45-2.38 (m, 1H), 2.02-1.97 (m, 1H).

The following compounds were synthesized according to the protocol described in Example 18-5:
I-184: MS [M+H]$^+$=356.1.
I-186: MS [M+H]$^+$=342.1.
I-192: MS [M+H]$^+$=427.8.

Example 18-6: 3-(1-oxo-5-(1,2,3,4-tetrahydroquinolin-4-yl)isoindolin-2-yl)piperidine-2,6-dione (I-196)

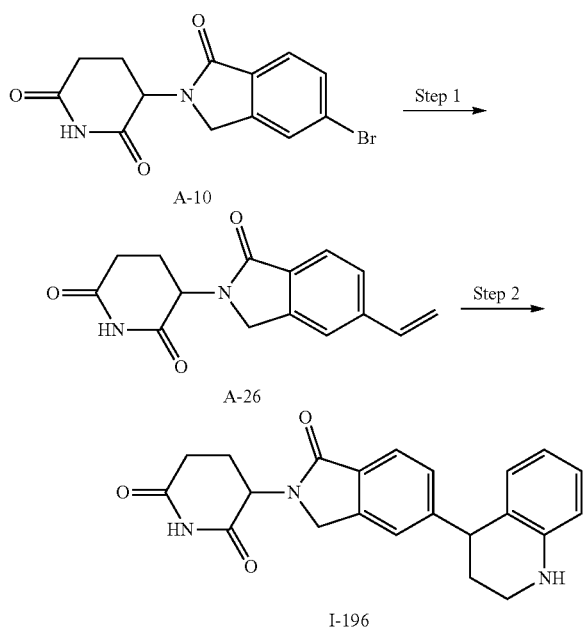

Step 1: 3-(1-oxo-5-vinylisoindolin-2-yl)piperidine-2,6-dione (A-26)

To a solution of A-10 (1.5 g, 4.66 mmol) and tributyl (vinyl)stannane (2.04 mL, 6.95 mmol) in dioxane (15 mL) was added PdCl$_2$(PPh$_3$)$_2$ (162 mg, 0.23 mmol) and the resulting mixture was purged with argon for 10 min and then stirred at 110° C. for 1 h in the microwave. After complete consumption of the starting material, the reaction mixture was quenched with water and extracted with EtOAc (2×50 mL). The combined organic extracts were washed with brine, dried over Na$_2$SO$_4$, and concentrated under reduced pressure. The obtained crude material was purified by silica gel chromatography eluting with 90% EtOAc in hexane. The pure fractions were collected and evaporated under reduced pressure to afford A-26 as a solid (500 mg, 1.85 mmol, 40% yield). MS [M+H]$^+$=271.2.

Step 2: 3-(1-oxo-5-(1,2,3,4-tetrahydroquinolin-4-yl)isoindolin-2-yl)piperidine-2,6-dione (I-196)

To a solution of A-26 (200 g, 0.74 mmol) and (azidomethyl)benzene (118 mg, 0.89 mmol) in DCM (4 mL) was added triflic acid (0.08 mL, 0.89 mmol) and the resulting mixture was stirred at room temperature for 2 h. After complete consumption of the starting material, the reaction mixture was quenched with water and extracted with EtOAc (2×50 mL). The combined organic extracts were washed with brine, dried over Na$_2$SO$_4$ and concentrated under reduced pressure. The obtained crude material was purified by reverse phase HPLC (eluting with 0.01% NH$_4$OAc in MeCN) to afford I-196 as a solid (15 mg, 0.04 mmol, 6% yield). MS [M+H]$^+$=376.2. $^1$H NMR (400 MHz, DMSO-d$_6$): δ 10.96 (s, 1H), 7.66 (d, J=8.0 Hz, 1H), 7.32-7.23 (m, 2H), 6.92 (t, J=7.6 Hz, 1H), 6.59-6.55 (m, 2H), 6.41 (t, J=7.2 Hz, 1H), 5.08 (dd, J=13.2, 5.2 Hz, 1H), 4.44-4.23 (m, 3H), 3.24-3.18 (m, 1H), 3.10-3.05 (m, 1H), 2.95-2.86 (m, 1H), 2.66-2.50 (m, 2H), 2.42-2.31 (m, 1H), 2.10-1.98 (m, 3H).

Compound I-197 was synthesized in the same manner described above in Example 18-6. I-197: MS [M+H]$^+$= 466.2.

EQUIVALENTS

The disclosures of each and every patent, patent application, and publication cited herein are hereby incorporated herein by reference in their entireties. While this invention has been disclosed with reference to specific aspects, it is apparent that other aspects and variations of this invention may be devised by others skilled in the art without departing from the true spirit and scope of the invention. The appended claims are intended to be construed to include all such aspects and equivalent variations.

SEQUENCE LISTING (1560 sequences)

SEQ ID NO: 1 - protein, 60 aa, Unknown
  source: /note="Description of Unknown: IKZF3 sequence"
MHKRSHTGERPFQCNQCGASFTQKGNLLRHIKLHTGEKPFKCHLCNTASAEARHIKAEMG

SEQ ID NO: 2 - protein, 60 aa, Unknown
  source: /note="Description of Unknown: IKZF3 sequence"
MHRRSHTGERPFQCNQCGASFTQRGNLLRHIRLHTGERPFRCHLCNTASAEARHIRAEMG

SEQ ID NO: 3 - protein, 59 aa, Unknown
  source: /note="Description of Unknown: IKZF3 sequence"
HKRSHTGERPFQCNQCGASFTQKGNLLRHIKLHTGEKPFKCHLCNTASAEARHIKAEMG

SEQ ID NO: 4 - protein, 59 aa, Unknown
  source: /note="Description of Unknown: IKZF3 sequence"
HRRSHTGERPFQCNQCGASFTQRGNLLRHIRLHTGERPFRCHLCNTASAEARHIRAEMG

SEQ ID NO: 5 - protein, 45 aa, Unknown
  source: /note="Description of Unknown: IKZF3 sequence"
HKRSHTGERPFQCNQCGASFTQKGNLLRHIKLHTGEKPFKCHLCN

SEQ ID NO: 6 - protein, 35 aa, Unknown
  source: /note="Description of Unknown: IKZF3 sequence"
HKRSHTGERPFQCNQCGASFTQKGNLLRHIKLHTG

SEQ ID NO: 7 - protein, 31 aa, Unknown
  source: /note="Description of Unknown: IKZF3 sequence"
HTGERPFQCNQCGASFTQKGNLLRHIKLHTG

SEQ ID NO: 8 - protein, 23 aa, Unknown
  source: /note="Description of Unknown: IKZF3 sequence"
TGERPFQCNQCGASFTQKGNLLR

SEQ ID NO: 9 - protein, 26 aa, Unknown
  source: /note="Description of Unknown: IKZF3 sequence"
PFQCNQCGASFTQKGNLLRHIKLHTG

SEQ ID NO: 10 - protein, 11 aa, Unknown
  source: /note="Description of Unknown: IKZF3 sequence"
PFQCNQCGASF

SEQ ID NO: 11 - protein, 14 aa, Unknown
  source: /note="Description of Unknown: IKZF3 sequence"
TASAEARHIKAEMG

SEQ ID NO: 12 - protein, 60 aa, Unknown
  source: /note="Description of Unknown: IKZF3 sequence"
MHKRSHTGERPFQCNQCGASFTQKGNLLRHIKLHTGEKPFKCHLCNTASAEARHIRAEMG

SEQ ID NO: 13 - protein, 60 aa, Unknown
  source: /note="Description of Unknown: IKZF3 sequence"
MHKRSHTGERPFQCNQCGASFTQKGNLLRHIKLHTGEKPFKCHLCNTASAEARHISAEMG

SEQ ID NO: 14 - protein, 60 aa, Unknown
  source: /note="Description of Unknown: IKZF3 sequence"
MHKRSHTGERPFQCNQCGASFTQKGNLLRHIKLHTGEKPFKCHLCNMALEKMALEKMALE

SEQ ID NO: 15 - protein, 50 aa, Unknown
  source: /note="Description of Unknown: IKZF3 sequence"
MHKRSHTGERPFQCNQCGASFTQKGNLLRHIKLHTGMALEKMALEKMALE

SEQ ID NO: 16 - protein, 46 aa, Unknown
  source: /note="Description of Unknown: IKZF3 sequence"
MHTGERPFQCNQCGASFTQKGNLLRHIKLHTGMALEKMALEKMALE

SEQ ID NO: 17 - protein, 38 aa, Unknown
  source: /note="Description of Unknown: IKZF3 sequence"
MTGERPFQCNQCGASFTQKGNLLRMALEKMALEKMALE

SEQ ID NO: 18 - protein, 26 aa, Unknown
  source: /note="Description of Unknown: IKZF3 sequence"
MPFQCNQCGASFMALEKMALEKMALE

SEQ ID NO: 19 - protein, 509 aa, Homo sapiens
MEDIQTNAELKSTQEQSVPAESAAVLNDYSLTKSHEMENVDSGEGPANEDEDIGDDSMKVKDEYSERDENVLKSEPMGNAEEPEIPYSYSREYNEYENIKLERHVVSFDSSRPTSGKMNCDVCGLSCISFNVLMVHKRSHTGERPFQCNQCGASFTQKGNLLRHIKLHTGEKPFKCHLCNYACQRRDALTGHLRTHSVEKPYKCEFCGRSYKQRSSLEEHKERCRTFLQSTDPGDTASAEARHIKAEMGSERALVLDRLASNVAKRKSSMPQKFIGEKRHCFDVNYNSSYMYEKESELIQTRMMDQAINNAISYLGAEALRPLVQTPPAPTSEMVPVISSMYPIALTRAEMSNGAPQELEKKSIHLPEKSVPSERGLSPNNSGHDSTDTDSNHEERQNHIYQQNHMVLSRARNGMPLLKEVPRSYELLKPPPICPRDSVKVINKEGEVMDVYRCDHCRVLFLDYVMFTIHMGCHGFRDPFECNMCGYRSHDRYEFSSHIARGEHRALLK

SEQ ID NO: 20 - protein, 519 aa, Homo sapiens
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 21 - protein, 526 aa, Homo sapiens [sequence omitted]

SEQ ID NO: 22 - protein, 585 aa, Homo sapiens
MHTPPALPRRFQGGGRVRTPGSHRQGKDNLERDPSGGCVPDFLPQAQDSNHFIMESLFCESSGDSSLEKEFLGAPVGPSVSTPNSQHSSPSRSLSANSIKVEMYSDEESSRLLGPDERLLEKDDSVIVEDSLSEPLGYCDGSGPEPHSPGGIRLPNGKLKCDVCGMVCIGPNVLMVHKRSHTGERPFHCNQCGASFTQKGNLLRHIKLHSGEKPFKCPFCNYACRRRDALTGHLRTHSVSSPTVGKPYKCNYCGRSYKQQSTLEEHKERCHNYLQSLSTEAQALAGQPGDEIRDLEMVPDSMLHSSSERPTFIDRLANSLTKRKRSTPQKFVGEKQMRFSLSDLPYDVNSGGYEKDVELVAHHSLEPGFGSSLAFVGAEHLRPLRLPPTNCISELTPVISSVYTQMQPLPGRLELPGSREAGEGPEDLADGGPLLYRPRGPLTDPGASPSNGCQDSTDTESNHEDRVAGVVSLPQGPPPQPPPTIVVGRHSPAYAKEDPKPQEGLLRGTPGPSKEVLRVVGESGEPVKAFKCEHCRILFLDHVMFTIHMGCHGFRDPFECNICGYHSQDRYEFSSHIVRGEHKVG

SEQ ID NO: 23 - protein, 419 aa, Unknown
  source: /note="Description of Unknown: IKZF5 sequence"
MGEKKPEPLDFVKDFQEYLTQQTHHVNMISGSVSGDKEAEALQGAGTDGDQNGLDHPSVEVSLDENSGMLVDGFERTFDGKLKCRYCNYASKGTARLIEHIRIHTGEKPHRCHLCPFASAYERHLEAHMRSHTGEKPYKCELCSFRCSDRSNLSHHRRRKHKMVPIKGTRSSLSSKKMWGVLQKKTSNLGYSRRALINLSPPSMVVQKPDYLNDFTHEIPNIQTDSYESMAKTTPTGGLPRDPQELMVDNPLNQLSTLAGQLSSLPPENQNPASPDVVPCPDEKPFMIQQPSTQAVVSAVSASIPQSSSPTSPEPRPSHSQRNYSPVAGPSSEPSAHTSTPSIGNSQPSTPAPALPVQDPQLLHHCQHCDMYFADNILYTIHMGCHGYENPFQCNICGCKCKNKYDFACHFARGQHNQH

SEQ ID NO: 24 - protein, 30 aa, Unknown
  source: /note="Description of Unknown: IKZF3 sequence"
HTGERPFQCNQCGASFTQKGNLLRHIKLHT

SEQ ID NO: 25-26 - skipped (2 entries)

SEQ ID NO: 27 - protein, 46 aa, Unknown
  source: /note="Description of Unknown: IKZF3 sequence"
MHKRSHTGERPFHCNQCGASFTQKGNLLRHIKLHTGEKPFKCHLCN

SEQ ID NO: 28 - protein, 16 aa, Artificial Sequence
  source: /note="Description of Artificial Sequence: Synthetic peptide"
GGGGSGGGGTGGGGSG

SEQ ID NO: 29 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 30 - protein, 562 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGGGSGGGGTGGGGSGMHKRSHTGERPFQCNQCGASFTQKGNLLRHIKLHTGEKPFKCHLCNTASAEARHIKAEMG

SEQ ID NO: 31 - protein, 562 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGGGSGGGGTGGGGSGMHRRSHTGERPFQCNQCGASFTQRGNLLRHIRLHTGERPFRCHLCNTASAEARHIRAEMG

SEQ ID NO: 32 - protein, 829 aa, Artificial Sequence
  source: /note="Description of Artificial Sequence: Synthetic polypeptide"
MALPVTALLLPLALLLHAARPRSSLALSLTADQMVSALLDAEPPILYSEYDPTRPFSEASMMGLLTNLADRELVHMINWAKRVPGFVDLALHDQVHLLECAWMEILMIGLVWRSMEHPGKLLFAPNLLLDRNQGKCVEGGVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSSKRMEHLYSMKCKNVVPLSDLLLEMLDAHRLGTGAEDPRPSRKRRSLGDVGEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGGGSGGGGTGGGGSGMHKRSHTGERPFQCNQCGASFTQKGNLLRHIKLHTGEKPFKCHLCNTASAEARHIKAEMG

SEQ ID NO: 33 - protein, 829 aa, Artificial Sequence
  source: /note="Description of Artificial Sequence: Synthetic polypeptide"
MALPVTALLLPLALLLHAARPRSSLALSLTADQMVSALLDAEPPILYSEYDPTRPFSEASMMGLLTNLADRELVHMINWAKRVPGFVDLALHDQVHLLECAWMEILMIGLVWRSMEHPGKLLFAPNLLLDRNQGKCVEGGVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSSKRMEHLYSMKCKNVVPLSDLLLEMLDAHRLGTGAEDPRPSRKRRSLGDVGEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGGGSGGGGTGGGGSGMHRRSHTGERPFQCNQCGASFTQRGNLLRHIRLHTGERPFRCHLCNTASAEARHIRAEMG

SEQ ID NO: 34 - protein, 8 aa, Artificial Sequence
  source: /note="Description of Artificial Sequence: Synthetic peptide"
SARNRQKR

SEQ ID NO: 35 - protein, 383 aa, Artificial Sequence
  source: /note="Description of Artificial Sequence: Synthetic polypeptide"
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 36 - protein, 383 aa, Artificial Sequence
  source: /note="Description of Artificial Sequence: Synthetic polypeptide"
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVSGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 37 - protein, 16 aa, Artificial Sequence
  source: /note="Description of Artificial Sequence: Synthetic peptide"
SGSETPGTSESATPES

SEQ ID NO: 38 - protein, 33 aa, Artificial Sequence
  source: /note="Description of Artificial Sequence: Synthetic polypeptide"
GGGGSGGGGTGGGGGSGGGGTGGGGGSGGGGTG

SEQ ID NO: 39 - protein, 33 aa, Artificial Sequence
  source: /note="Description of Artificial Sequence: Synthetic polypeptide"
GGGGSGGGGTGGGGSGGKPIPNPLLGLASTGSG

SEQ ID NO: 40 - protein, 4 aa, Homo sapiens
HKRS

SEQ ID NO: 41 - protein, 45 aa, Unknown
  source: /note="Description of Unknown: IKZF3 sequence"
HRRSHTGERPFQCNQCGASFTQRGNLLRHIRLHTGERPFRCHLCN

SEQ ID NO: 42 - protein, 35 aa, Unknown
  source: /note="Description of Unknown: IKZF3 sequence"
HRRSHTGERPFQCNQCGASFTQRGNLLRHIRLHTG

SEQ ID NO: 43 - protein, 14 aa, Unknown
  source: /note="Description of Unknown: IKZF3 sequence"
TASAEARHIRAEMG

SEQ ID NO: 44 - protein, 245 aa, Artificial Sequence
  source: /note="Description of Artificial Sequence: Synthetic polypeptide"
SLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEMLDAHRL

SEQ ID NO: 45 - DNA, 735 bp, Artificial Sequence
  source: /note="Description of Artificial Sequence: Synthetic polynucleotide"
tcgttggcactttccctgactgccgaccagatggtgtccgcccttctggacgccgagcctccaattctgtactcggagtacgatccgactcgcccgttctccgaagccagcatgatgggcctgttgactaacctggcggaccgcgagttggtgcacatgattaactgggctaagcgggtgccgggcttcgtggacctgactctgcacgaccaagtgcacctcctggaatgcgcctggctggaaatcctcatgatcggcctcgtgtggagatccatggagcatcccggaaagctcctgtttgcacccaacctcctgcttgatcgcaaccagggaaaatgcgtggaagggatggtcgagattttcgacatgctgctcgccacctcttcccggttccggatgatgaatctgcagggagaagagttcgtgtgtctgaagtcaatcatcctgctgaactccggggtctataccttcctgagctcgaccctcaagtcactggaggaaaaagaccacatccatcgcgtgctcgataagatcaccgacacccttatccatctcatggcgaaggctggactgaccctgcaacagcagcaccagaggctggcccagttgctgctgattctgagccacatccggcacatgtcgaacaaggggatggaacacctgtacagcatgaagtgcaagaacgtcgtgcctctgtacgatctgctcctggaaatgctggacgcgcacagactc

SEQ ID NO: 46 - protein, 245 aa, Artificial Sequence
  source: /note="Description of Artificial Sequence: Synthetic polypeptide"
SLALSLTADQMVSALLDAEPPILYSEYDPTRPFSEASMMGLLTNLADRELVHMINWAKRVPGFVDLALHDQVHLLECAWMEILMIGLVWRSMEHPGKLLFAPNLLLDRNQGKCVEGGVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSSKRMEHLYSMKCKNVVPLSDLLLEMLDAHRL

SEQ ID NO: 47 - DNA, 735 bp, Artificial Sequence
  source: /note="Description of Artificial Sequence: Synthetic polynucleotide"
tcgttggcactttccctgactgccgaccagatggtgtccgcccttctggacgccgagcctccaattctgtactcggagtacgatccgactcgcccgttctccgaagccagcatgatgggcctgttgactaacctggcggaccgcgagttggtgcacatgattaactgggctaagcgggtgccgggcttcgtggacctggccctgcacgaccaagtgcacctcctggaatgcgcctggatggaaatcctcatgatcggcctcgtgtggagatccatggagcatcccggaaagctcctgtttgcacccaacctcctgcttgatcgcaaccagggaaaatgcgtggaagggggtgtcgagattttcgacatgctgctcgccacctcttcccggttccggatgatgaatctgcagggagaagagttcgtgtgtctgaagtcaatcatcctgctgaactccggggtctataccttcctgagctcgaccctcaagtcactggaggaaaaagaccacatccatcgcgtgctcgataagatcaccgacacccttatccatctcatggcgaaggctggactgaccctgcaacagcagcaccagaggctggcccagttgctgctgattctgagccacatccggcacatgtcgtccaagaggatggaacacctgtacagcatgaagtgcaagaacgtcgtgcctctgtccgatctgctcctggaaatgctggacgcgcacagactc

SEQ ID NO: 48 - protein, 245 aa, Artificial Sequence
  source: /note="Description of Artificial Sequence: Synthetic polypeptide"
SLALSLTADQMVSALLDAEPPILYSEYDPTRPFSEASMMGLLTNLADRELVHMINWAKRVPGFVDLTLHDQVHLLECAWMEILMIGLVWRSMEHPGKLLFAPNLLLDRNQGKCVEGGVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKRMEHLYSMKCKNVVPLSDLLLEMLDAHRL

SEQ ID NO: 49 - DNA, 735 bp, Artificial Sequence
  source: /note="Description of Artificial Sequence: Synthetic polynucleotide"
tcgttggcactttccctgactgccgaccagatggtgtccgcccttctggacgccgagcctccaattctgtactcggagtacgatccgactcgcccgttctccgaagccagcatgatgggcctgttgactaacctggcggaccgcgagttggtgcacatgattaactgggctaagcgggtgccgggcttcgtggacctgaccctgcacgaccaagtgcacctcctggaatgcgcctggatggaaatcctcatgatcggcctcgtgtggagatccatggagcatcccggaaagctcctgtttgcacccaacctcctgcttgatcgcaaccagggaaaatgcgtggaagggggtgtcgagattttcgacatgctgctcgccacctcttcccggttccggatgatgaatctgcagggagaagagttcgtgtgtctgaagtcaatcatcctgctgaactccggggtctataccttcctgagctcgaccctcaagtcactggaggaaaaagaccacatccatcgcgtgctcgataagatcaccgacacccttatccatctcatggcgaaggctggactgaccctgcaacagcagcaccagaggctggcccagttgctgctgattctgagccacatccggcacatgtcgaacaagaggatggaacacctgtacagcatgaagtgcaagaacgtcgtgcctctgtccgatctgctcctggaaatgctggacgcgcacagactc

SEQ ID NO: 50 - protein, 107 aa, Artificial Sequence
  source: /note="Description of Artificial Sequence: Synthetic polypeptide"
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 51 - protein, 158 aa, Artificial Sequence
  source: /note="Description of Artificial Sequence: Synthetic polypeptide"
ISLIAALAVDYVIGMENAMPWNLPADLAWFKRNTLNKPVIMGRHTWESIGRPLPGRKNIILSSQPSTDDRVTWVKSVDEAIAACGDVPEIMVIGGGRVIEQFLPKAQKLYLTHIDAEVEGDTHFPDYEPDDWESVFSEFHDADAQNSHSYCFEILERR

SEQ ID NO: 52 - protein, 4 aa, Artificial Sequence
  source: /note="Description of Artificial Sequence: Synthetic peptide"
  MOD_RES (2)..(2): Any amino acid
  VARIANT (3)..(3): /replace="Arg"
  SITE (1)..(4): /note="Variant residues given in the sequence have no preference with respect to those in the annotations for variant positions"
RXKR

SEQ ID NO: 53 - protein, 6 aa, Artificial Sequence
  source: /note="Description of Artificial Sequence: Synthetic peptide"
  MOD_RES (2)..(4): Any amino acid
  VARIANT (5)..(5): /replace="Arg"
  SITE (1)..(6): /note="Variant residues given in the sequence have no preference with respect to those in the annotations for variant positions"
RXXXKR

SEQ ID NO: 54 - protein, 3 aa, Artificial Sequence
  source: /note="Description of Artificial Sequence: Synthetic peptide"
  MOD_RES (3)..(3): Any amino acid
RRX

SEQ ID NO: 55 - protein, 5 aa, Artificial Sequence
  source: /note="Description of Artificial Sequence: Synthetic peptide"
  MOD_RES (5)..(5): Any amino acid
IEPDX

SEQ ID NO: 56 - protein, 4 aa, Unknown
  source: /note="Description of Unknown: Factor XA sequence"
  VARIANT (2)..(2): /replace="Asp"
  SITE (1)..(4): /note="Variant residues given in the sequence have no preference with respect to those in the annotations for variant positions"
IEGR

SEQ ID NO: 57 - protein, 5 aa, Unknown
  source: /note="Description of Unknown: Enterokinase sequence"
DDDDK

SEQ ID NO: 58 - protein, 6 aa, Unknown
  source: /note="Description of Unknown: Genenase sequence"
PGAAHY

SEQ ID NO: 59 - protein, 5 aa, Artificial Sequence
  source: /note="Description of Artificial Sequence: Synthetic peptide"
  MOD_RES (3)..(3): Any amino acid
  VARIANT (5)..(5): /replace="Ala"
  SITE (1)..(5): /note="Variant residues given in the sequence have no preference with respect to those in the annotations for variant positions"
LPXTG

SEQ ID NO: 60 - protein, 7 aa, Unknown
  source: /note="Description of Unknown: PreScission protease sequence"
LEVFQGP

SEQ ID NO: 61 - protein, 6 aa, Unknown
  source: /note="Description of Unknown: Thrombin sequence"
LVPRGS

SEQ ID NO: 62 - protein, 7 aa, Unknown
  source: /note="Description of Unknown: TEV protease sequence"
ENLYFQG

SEQ ID NO: 63 - protein, 2 aa, Unknown
  source: /note="Description of Unknown: Elastase 1 sequence"
  VARIANT (1)..(1): /replace="Gly" or "Ser" or "Val"
  MOD_RES (2)..(2): Any amino acid
  SITE (1)..(2): /note="Variant residues given in the sequence have no preference with respect to those in the annotations for variant positions"
AX

SEQ ID NO: 64 - protein, 21 aa, Artificial Sequence
  source: /note="Description of Artificial Sequence: Synthetic peptide"
MALPVTALLLPLALLLHAARP

SEQ ID NO: 65 - protein, 22 aa, Artificial Sequence
  source: /note="Description of Artificial Sequence: Synthetic peptide"
MLLLVTSLLLCELPHPAFLLIP

SEQ ID NO: 66 - protein, 20 aa, Artificial Sequence
  source: /note="Description of Artificial Sequence: Synthetic peptide"
MYRMQLLSCIALSLALVTNS

SEQ ID NO: 67 - protein, 21 aa, Artificial Sequence
  source: /note="Description of Artificial Sequence: Synthetic peptide"
MAQVKLQESGTELAKPGAAVK

SEQ ID NO: 68 - protein, 19 aa, Artificial Sequence
  source: /note="Description of Artificial Sequence: Synthetic peptide"
MRFLAATFLLLALSTAAQA

SEQ ID NO: 69 - protein, 21 aa, Artificial Sequence
  source: /note="Description of Artificial Sequence: Synthetic peptide"
MGLLQLLAFSFLALCRARVRA

SEQ ID NO: 70 - protein, 21 aa, Artificial Sequence
  source: /note="Description of Artificial Sequence: Synthetic peptide"
MLLAWVQAFLVSNMLLAEAYG

SEQ ID NO: 71 - protein, 21 aa, Artificial Sequence
  source: /note="Description of Artificial Sequence: Synthetic peptide"
MKFQGPLACLLLALCLGSGEA

SEQ ID NO: 72 - protein, 22 aa, Artificial Sequence
  source: /note="Description of Artificial Sequence: Synthetic peptide"
MDAMKRGLCCVLLLCGAVFVSP

SEQ ID NO: 73 - protein, 35 aa, Artificial Sequence
  source: /note="Description of Artificial Sequence: Synthetic polypeptide"
MGTVSSRRSWWPLPLLLLLLLLLGPAGARAQEDED

SEQ ID NO: 74 - protein, 4 aa, Artificial Sequence
  source: /note="Description of Artificial Sequence: Synthetic peptide"
KDEL

SEQ ID NO: 75 - protein, 4 aa, Artificial Sequence
  source: /note="Description of Artificial Sequence: Synthetic peptide"
  MOD_RES (3)..(4): Any amino acid
KKXX

SEQ ID NO: 76 - protein, 3 aa, Artificial Sequence
  source: /note="Description of Artificial Sequence: Synthetic peptide"
  MOD_RES (2)..(2): Any amino acid except Pro, Ser, or Thr
  VARIANT (3)..(3): /replace="Thr"
  SITE (1)..(3): /note="Variant residues given in the sequence have no preference with respect to those in the annotations for variant positions"
NXS

SEQ ID NO: 77 - protein, 46 aa, Unknown
  source: /note="Description of Unknown: IKZF3 sequence"
MHKRSHTGERPFQCNQCGASFTQKGNLLRHIKLHTGEKPFKCHLCN

SEQ ID NO: 78 - protein, 36 aa, Unknown
  source: /note="Description of Unknown: IKZF3 sequence"
MHKRSHTGERPFQCNQCGASFTQKGNLLRHIKLHTG

SEQ ID NO: 79 - protein, 32 aa, Unknown
  source: /note="Description of Unknown: IKZF3 sequence"
MHTGERPFQCNQCGASFTQKGNLLRHIKLHTG

SEQ ID NO: 80 - protein, 31 aa, Unknown
  source: /note="Description of Unknown: IKZF3 sequence"
MHTGERPFQCNQCGASFTQKGNLLRHIKLHT

SEQ ID NO: 81 - protein, 24 aa, Unknown
  source: /note="Description of Unknown: IKZF3 sequence"
MTGERPFQCNQCGASFTQKGNLLR

SEQ ID NO: 82 - protein, 27 aa, Unknown
  source: /note="Description of Unknown: IKZF3 sequence"
MPFQCNQCGASFTQKGNLLRHIKLHTG

SEQ ID NO: 83 - protein, 12 aa, Unknown
  source: /note="Description of Unknown: IKZF3 sequence"
MPFQCNQCGASF

SEQ ID NO: 84 - protein, 59 aa, Unknown
  source: /note="Description of Unknown: IKZF3 sequence"
HKRSHTGERPFQCNQCGASFTQKGNLLRHIKLHTGEKPFKCHLCNTASAEARHIRAEMG

SEQ ID NO: 85 - protein, 59 aa, Unknown
  source: /note="Description of Unknown: IKZF3 sequence"
HKRSHTGERPFQCNQCGASFTQKGNLLRHIKLHTGEKPFKCHLCNMALEKMALEKMALE

SEQ ID NO: 86 - protein, 49 aa, Unknown
  source: /note="Description of Unknown: IKZF3 sequence"
HKRSHTGERPFQCNQCGASFTQKGNLLRHIKLHTGMALEKMALEKMALE

SEQ ID NO: 87 - protein, 45 aa, Unknown
  source: /note="Description of Unknown: IKZF3 sequence"
HTGERPFQCNQCGASFTQKGNLLRHIKLHTGMALEKMALEKMALE

SEQ ID NO: 88 - protein, 37 aa, Unknown
  source: /note="Description of Unknown: IKZF3 sequence"
TGERPFQCNQCGASFTQKGNLLRMALEKMALEKMALE

SEQ ID NO: 89 - protein, 25 aa, Unknown
  source: /note="Description of Unknown: IKZF3 sequence"
PFQCNQCGASFMALEKMALEKMALE

SEQ ID NO: 90 - protein, 45 aa, Unknown
  source: /note="Description of Unknown: IKZF3 sequence"
HKRSHTGERPFHCNQCGASFTQKGNLLRHIKLHTGEKPFKCHLCN

SEQ ID NO: 91 - protein, 14 aa, Unknown
  source: /note="Description of Unknown: IKZF3 sequence"
MALEKMALEKMALE

SEQ ID NO: 92 - protein, 753 aa, Artificial Sequence
  source: /note="Description of Artificial Sequence: Synthetic polypeptide"
MALPVTALLLPLALLLHAARPRSSLALSLTADQMVSALLDAEPPILYSEYDPTRPFSEASMMGLLTNLADRELVHMINWAKRVPGFVDLALHDQVHLLECAWMEILMIGLVWRSMEHPGKLLFAPNLLLDRNQGKCVEGGVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSSKRMEHLYSMKCKNVVPLSDLLLEMLDAHRLGTGAEDPRPSRKRRSLGDVGEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 93 - protein, 843 aa, Artificial Sequence
  source: /note="Description of Artificial Sequence: Synthetic polypeptide"
MALPVTALLLPLALLLHAARPRSSLALSLTADQMVSALLDAEPPILYSEYDPTRPFSEASMMGLLTNLADRELVHMINWAKRVPGFVDLALHDQVHLLECAWMEILMIGLVWRSMEHPGKLLFAPNLLLDRNQGKCVEGGVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSSKRMEHLYSMKCKNVVPLSDLLLEMLDAHRLGTGAEDPRPSRKRRSLGDVGEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGGGSGGGGTGGGGSGMHKRSHTGERPFQCNQCGASFTQKGNLLRHIKLHTGEKPFKCHLCNTASAEARHIKAEMGGKPIPNPLLGLDST

SEQ ID NO: 94 - protein, 576 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGGGSGGGGTGGGGSGMHKRSHTGERPFQCNQCGASFTQKGNLLRHIKLHTGEKPFKCHLCNTASAEARHIKAEMGGKPIPNPLLGLDST

SEQ ID NO: 95 - protein, 560 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRMHKRSHTGERPFQCNQCGASFTQKGNLLRHIKLHTGEKPFKCHLCNTASAEARHIKAEMGGKPIPNPLLGLDST

SEQ ID NO: 96 - protein, 576 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRKGGGSKGGGTKGGGSKMHKRSHTGERPFQCNQCGASFTQKGNLLRHIKLHTGEKPFKCHLCNTASAEARHIKAEMGGKPIPNPLLGLDST

SEQ ID NO: 97 - protein, 570 aa, Artificial Sequence
  source: /note="Description of Artificial Sequence: Synthetic polypeptide"
MALPVTALLLPLALLLHAARPRSSLAHKRSHTGERPFQCNQCGASFTQKGNLLRHIKLHTGEKPFKCHLCNTASAEARHIKAEMGGTGAEDPRPSRKRRSLGDVGEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 98 - protein, 565 aa, Artificial Sequence
  source: /note="Description of Artificial Sequence: Synthetic polypeptide"
MALPVTALLLPLALLLHAARPHKRSHTGERPFQCNQCGASFTQKGNLLRHIKLHTGEKPFKCHLCNTASAEARHIKAEMGGTGAEDPRPSRKRRSLGDVGEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 99 - protein, 16 aa, Artificial Sequence
  source: /note="Description of Artificial Sequence: Synthetic peptide"
KGGGSKGGGTKGGGSK

SEQ ID NO: 100 - protein, 59 aa, Unknown
  source: /note="Description of Unknown: IKZF3 sequence"
HKRSHTGERPFQCNQCGASFTQKGNLLRHIKLHTGEKPFKCHLCNTASAEARHISAEMG

SEQ ID NO: 101 - protein, 459 aa, Artificial Sequence
  source: /note="Description of Artificial Sequence: Synthetic polypeptide"
MHKRSHTGERPFQCNQCGASFTQKGNLLRHIKLHTGEKPFKCHLCNTASAEARHIKAEMGGGGGSGGGGTGGGGSGMAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 102 - protein, 715 aa, Artificial Sequence
  source: /note="Description of Artificial Sequence: Synthetic polypeptide"
MHKRSHTGERPFQCNQCGASFTQKGNLLRHIKLHTGEKPFKCHLCNTASAEARHIKAEMGGGGGSGGGGTGGGGSGMAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVSGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGLGSSGSETPGTSESATPESVSKGEELFTGVVPILVELDGDVNGHKFSVSGEGEGDATYGKLTLKFICTTGKLPVPWPTLVTTFGYGLQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSYQSALSKDPNEKRDHMVLLEFVTAAGITLGMDELYK

SEQ ID NO: 103 - protein, 709 aa, Artificial Sequence
  source: /note="Description of Artificial Sequence: Synthetic polypeptide"
MHKRSHTGERPFQCNQCGASFTQKGNLLRHIKLHTGEKPFKCHLCNTASAEARHIKAEMGGGGGSGGGGTGGGGSGMAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGLGGGGSGGGGTGGGGSGMDFKNLIWLKEVDSTQERLKEWNVSYGTALVADRQTKGRGGLGRKWLSQEGGLYFSFLLNPKEFENLLQLPLVLGLSVSEALEEITEIPFSLKWPNDVYFQEKKVSGVLCELSKDKLIVGIGINVNQREIPEEIKDRATTLYEITGKDWDRKEVLLKVLKRISENLKKFKEKSFKEFKGKIESKMLYLGEEVKLLGEGKITGKLVGLSEKGGALILTEEGIKEILSGEFSLRRS

SEQ ID NO: 104 - protein, 726 aa, Artificial Sequence
  source: /note="Description of Artificial Sequence: Synthetic polypeptide"
MHKRSHTGERPFQCNQCGASFTQKGNLLRHIKLHTGEKPFKCHLCNTASAEARHIKAEMGGGGGSGGGGTGGGGSGMAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGLGGGGSGGGGTGGGGSGGKPIPNPLLGLDSTGSGMDFKNLIWLKEVDSTQERLKEWNVSYGTALVADRQTKGRGGLGRKWLSQEGGLYFSFLLNPKEFENLLQLPLVLGLSVSEALEEITEIPFSLKWPNDVYFQEKKVSGVLCELSKDKLIVGIGINVNQREIPEEIKDRATTLYEITGKDWDRKEVLLKVLKRISENLKKFKEKSFKEFKGKIESKMLYLGEEVKLLGEGKITGKLVGLSEKGGALILTEEGIKEILSGEFSLRRS

SEQ ID NO: 105 - protein, 726 aa, Artificial Sequence
  source: /note="Description of Artificial Sequence: Synthetic polypeptide"
MHKRSHTGERPFQCNQCGASFTQKGNLLRHIKLHTGEKPFKCHLCNTASAEARHIKAEMGGGGGSGGGGTGGGGSGMAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGLGGGGSGGGGTGGGGGSGGGGTGGGGGSGGGGTGMDFKNLIWLKEVDSTQERLKEWNVSYGTALVADRQTKGRGGLGRKWLSQEGGLYFSFLLNPKEFENLLQLPLVLGLSVSEALEEITEIPFSLKWPNDVYFQEKKVSGVLCELSKDKLIVGIGINVNQREIPEEIKDRATTLYEITGKDWDRKEVLLKVLKRISENLKKFKEKSFKEFKGKIESKMLYLGEEVKLLGEGKITGKLVGLSEKGGALILTEEGIKEILSGEFSLRRS

SEQ ID NO: 106 - protein, 709 aa, Artificial Sequence
  source: /note="Description of Artificial Sequence: Synthetic polypeptide"
MHKRSHTGERPFQCNQCGASFTQKGNLLRHIKLHTGEKPFKCHLCNTASAEARHIKAEMGGGGGSGGGGTGGGGSGMAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGLSGSETPGTSESATPESMDFKNLIWLKEVDSTQERLKEWNVSYGTALVADRQTKGRGGLGRKWLSQEGGLYFSFLLNPKEFENLLQLPLVLGLSVSEALEEITEIPFSLKWPNDVYFQEKKVSGVLCELSKDKLIVGIGINVNQREIPEEIKDRATTLYEITGKDWDRKEVLLKVLKRISENLKKFKEKSFKEFKGKIESKMLYLGEEVKLLGEGKITGKLVGLSEKGGALILTEEGIKEILSGEFSLRRS

SEQ ID NO: 107 - protein, 633 aa, Artificial Sequence
  source: /note="Description of Artificial Sequence: Synthetic polypeptide"
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGLGGGGSGGGGTGGGGSGMDFKNLIWLKEVDSTQERLKEWNVSYGTALVADRQTKGRGGLGRKWLSQEGGLYFSFLLNPKEFENLLQLPLVLGLSVSEALEEITEIPFSLKWPNDVYFQEKKVSGVLCELSKDKLIVGIGINVNQREIPEEIKDRATTLYEITGKDWDRKEVLLKVLKRISENLKKFKEKSFKEFKGKIESKMLYLGEEVKLLGEGKITGKLVGLSEKGGALILTEEGIKEILSGEFSLRRS

SEQ ID NO: 108 - protein, 650 aa, Artificial Sequence
  source: /note="Description of Artificial Sequence: Synthetic polypeptide"
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGLGGGGSGGGGTGGGGSGGKPIPNPLLGLDSTGSGMDFKNLIWLKEVDSTQERLKEWNVSYGTALVADRQTKGRGGLGRKWLSQEGGLYFSFLLNPKEFENLLQLPLVLGLSVSEALEEITEIPFSLKWPNDVYFQEKKVSGVLCELSKDKLIVGIGINVNQREIPEEIKDRATTLYEITGKDWDRKEVLLKVLKRISENLKKFKEKSFKEFKGKIESKMLYLGEEVKLLGEGKITGKLVGLSEKGGALILTEEGIKEILSGEFSLRRS

SEQ ID NO: 109 - protein, 59 aa, Artificial Sequence
  source: /note="Description of Artificial Sequence: Synthetic polypeptide"
HKRSHTGERPFHCNQCGASFTQKGNLLRHIKLHSGEKPFKCPFCSAGQVMSHHVPPMED

SEQ ID NO: 110 - DNA, 318 bp, Artificial Sequence
  source: /note="Description of Artificial Sequence: Synthetic polynucleotide"
cagtcagtgggcctcggcggccaagcttggcaatccggtactgttggtgaagccattcaccatgcataaaaggagtcacactggtgaacgccccttccactgtaaccagtgtggagcttcttttactcagaagggcaaccttctgagacacataaagttacactctggagagaagccgttcaaatgtcctttctgtagcgctgggcaggtcatgagtcaccatgtacctcctatggaagatggtggtggcgggagcggaggtggaggcacgggcggtggaggttcggggaacgttatgctggaaatgctagaatataa

SEQ ID NO: 111 - DNA, 1814 bp, Artificial Sequence
  source: /note="Description of Artificial Sequence: Synthetic polynucleotide"
ccatttcaggtgtcgtgagcggccgctctagagccgaattcggatccatggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctcagagactacttactaccaatcatccctcaagtctcgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggggtggtggcgggagcggaggtggaggcacgggcggtggaggttcggggcataaaaggagtcacactggtgaacgccccttccactgtaaccagtgtggagcttcttttactcagaagggcaaccttctgagacacataaagttacactctggagagaagccgttcaaatgtcctttctgtagcgctgggcaggtcatgagtcaccatgtacctcctatggaagattaagtcgacgcgtaacccagctttcttgtacaaagtggttgatatccagcacagtggcggcgcgccattccgcccctctccctc

SEQ ID NO: 112 - protein, 561 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGGGSGGGGTGGGGSGHKRSHTGERPFHCNQCGASFTQKGNLLRHIKLHSGEKPFKCPFCSAGQVMSHHVPPMED

SEQ ID NO: 113 - protein, 45 aa, Artificial Sequence
  source: /note="Description of Artificial Sequence: Synthetic polypeptide"
HKRSHTGERPFHCNQCGASFTQKGNLLRHIKLHSGEKPFKCPFCS

SEQ ID NO: 114 - protein, 14 aa, Artificial Sequence
  source: /note="Description of Artificial Sequence: Synthetic peptide"
AGQVMSHHVPPMED

SEQ ID NO: 115-122 - skipped (8 entries)

SEQ ID NO: 123 - protein, 4 aa, Artificial Sequence
  source: /note="Description of Artificial Sequence: Synthetic peptide"
RTKR

SEQ ID NO: 124 - skipped

SEQ ID NO: 125 - protein, 20 aa, Artificial Sequence
  source: /note="Description of Artificial Sequence: Synthetic peptide"
GTGAEDPRPSRKRRSLGDVG

SEQ ID NO: 126 - DNA, 60 bp, Artificial Sequence
  source: /note="Description of Artificial Sequence: Synthetic oligonucleotide"
ggaaccggcgcggaagacccccggccctccaggaagcgaaggtccctcggagacgtgggt

SEQ ID NO: 127 - protein, 14 aa, Artificial Sequence
  source: /note="Description of Artificial Sequence: Synthetic peptide"
GTGAEDPRPSRKRR

SEQ ID NO: 128 - DNA, 42 bp, Artificial Sequence
  source: /note="Description of Artificial Sequence: Synthetic oligonucleotide"
ggaaccggcgcggaagacccccggccctccaggaagcgaagg

SEQ ID NO: 129 - protein, 15 aa, Artificial Sequence
  source: /note="Description of Artificial Sequence: Synthetic peptide"
LQWLEQQVAKRRTKR

SEQ ID NO: 130 - DNA, 45 bp, Artificial Sequence
  source: /note="Description of Artificial Sequence: Synthetic oligonucleotide"
ctgcaatggctggagcagcaggtggcgaagcggagaactaagcgg

SEQ ID NO: 131 - protein, 18 aa, Artificial Sequence
  source: /note="Description of Artificial Sequence: Synthetic peptide"
GTGAEDPRPSRKRRSLGG

SEQ ID NO: 132 - DNA, 54 bp, Artificial Sequence
  source: /note="Description of Artificial Sequence: Synthetic oligonucleotide"
ggcacaggtgccgaggaccctcggccaagccgcaaaaggaggtcacttggcggc

SEQ ID NO: 133 - protein, 17 aa, Artificial Sequence
  source: /note="Description of Artificial Sequence: Synthetic peptide"
GTGAEDPRPSRKRRSLG

SEQ ID NO: 134 - DNA, 51 bp, Artificial Sequence
  source: /note="Description of Artificial Sequence: Synthetic oligonucleotide"
ggaaccggagcagaagatcccagaccaagccggaaaaggcggtccctgggt

SEQ ID NO: 135 - protein, 14 aa, Artificial Sequence
  source: /note="Description of Artificial Sequence: Synthetic peptide"
SLNLTESHNSRKKR

SEQ ID NO: 136 - DNA, 42 bp, Artificial Sequence
  source: /note="Description of Artificial Sequence: Synthetic oligonucleotide"
agtctcaatttgactgagtcacacaattccaggaagaaaagg

SEQ ID NO: 137 - protein, 14 aa, Artificial Sequence
  source: /note="Description of Artificial Sequence: Synthetic peptide"
CKINGYPKRGRKRR

SEQ ID NO: 138 - DNA, 42 bp, Artificial Sequence
  source: /note="Description of Artificial Sequence: Synthetic oligonucleotide"
tgcaagatcaacggctaccctaagaggggcagaaagcggcgg

SEQ ID NO: 139 - DNA, 12 bp, Artificial Sequence
  source: /note="Description of Artificial Sequence: Synthetic oligonucleotide"
cgtactaaaaga

SEQ ID NO: 140 - protein, 26 aa, Artificial Sequence
  source: /note="Description of Artificial Sequence: Synthetic peptide"
MALPVTALLLPLALLLHAARPRSSLA

SEQ ID NO: 141 - protein, 20 aa, Artificial Sequence
  source: /note="Description of Artificial Sequence: Synthetic peptide"
GGGGSGGGGSGGGGSGGGGS

SEQ ID NO: 142 - protein, 15 aa, Artificial Sequence
  source: /note="Description of Artificial Sequence: Synthetic peptide"
GGGGSGGGGSGGGGS

SEQ ID NO: 143 - protein, 4 aa, Artificial Sequence
  source: /note="Description of Artificial Sequence: Synthetic peptide"
GGGS

SEQ ID NO: 144 - DNA, 1184 bp, Artificial Sequence
  source: /note="Description of Artificial Sequence: Synthetic polynucleotide"
cgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 145 - DNA, 63 bp, Artificial Sequence
  source: /note="Description of Artificial Sequence: Synthetic oligonucleotide"
atggccctgcctgtgacagccctgctgctgcctctggctctgctgctgcatgccgctagaccc

SEQ ID NO: 146 - DNA, 63 bp, Artificial Sequence
  source: /note="Description of Artificial Sequence: Synthetic oligonucleotide"
atggccctccctgtcaccgccctgctgcttccgctggctcttctgctccacgccgctcggccc

SEQ ID NO: 147 - protein, 45 aa, Artificial Sequence
  source: /note="Description of Artificial Sequence: Synthetic polypeptide"
TTTPAPRPPTPAPTIASQPLSLRPEACRPAAGGAVHTRGLDFACD

SEQ ID NO: 148 - DNA, 135 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgat

SEQ ID NO: 149 - protein, 230 aa, Artificial Sequence
  source: /note="Description of Artificial Sequence: Synthetic polypeptide"
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 150 - DNA, 690 bp, Artificial Sequence
  source: /note="Description of Artificial Sequence: Synthetic polynucleotide"
gagagcaagtacggccctccctgccccccttgccctgcccccgagttcctgggcggacccagcgtgttcctgttcccccccaagcccaaggacaccctgatgatcagccggacccccgaggtgacctgtgtggtggtggacgtgtcccaggaggaccccgaggtccagttcaactggtacgtggacggcgtggaggtgcacaacgccaagaccaagccccgggaggagcagttcaatagcacctaccgggtggtgtccgtgctgaccgtgctgcaccaggactggctgaacggcaaggaatacaagtgtaaggtgtccaacaagggcctgcccagcagcatcgagaaaaccatcagcaaggccaagggccagcctcgggagccccaggtgtacaccctgccccctagccaagaggagatgaccaagaaccaggtgtccctgacctgcctggtgaagggcttctaccccagcgacatcgccgtggagtgggagagcaacggccagcccgagaacaactacaagaccaccccccctgtgctggacagcgacggcagcttcttcctgtacagccggctgaccgtggacaagagccggtggcaggagggcaacgtctttagctgctccgtgatgcacgaggccctgcacaaccactacacccagaagagcctgagcctgtccctgggcaagatg

SEQ ID NO: 151 - protein, 282 aa, Artificial Sequence
  source: /note="Description of Artificial Sequence: Synthetic polypeptide"
RWPESPKAQASSVPTAQPQAEGSLAKATTAPATTRNTGRGGEEKKKEKEKEEQEERETKTPECPSHTQPLGVYLLTPAVQDLWLRDKATFTCFVVGSDLKDAHLTWEVAGKVPTGGVEEGLLERHSNGSQSQHSRLTLPRSLWNAGTSVTCTLNHPSLPPQRLMALREPAAQAPVKLSLNLLASSDPPEAASWLLCEVSGFSPPNILLMWLEDQREVNTSGFAPARPPPQPGSTTFWAWSVLRVPAPPSPQPATYTCVVSHEDSRTLLNASRSLEVSYVTDH

SEQ ID NO: 152 - DNA, 847 bp, Artificial Sequence
  source: /note="Description of Artificial Sequence: Synthetic polynucleotide"
aggtggcccgaaagtcccaaggcccaggcatctagtgttcctactgcacagccccaggcagaaggcagcctagccaaagctactactgcacctgccactacgcgcaatactggccgtggcggggaggagaagaaaaaggagaaagagaaagaagaacaggaagagagggagaccaagacccctgaatgtccatcccatacccagccgctgggcgtctatctcttgactcccgcagtacaggacttgtggcttagagataaggccacctttacatgtttcgtcgtgggctctgacctgaaggatgcccatttgacttgggaggttgccggaaaggtacccacagggggggttgaggaagggttgctggagcgccattccaatggctctcagagccagcactcaagactcacccttccgagatccctgtggaacgccgggacctctgtcacatgtactctaaatcatcctagcctgcccccacagcgtctgatggcccttagagagccagccgcccaggcaccagttaagcttagcctgaatctgctcgccagtagtgatcccccagaggccgccagctggctcttatgcgaagtgtccggctttagcccgcccaacatcttgctcatgtggctggaggaccagcgagaagtgaacaccagcggcttcgctccagcccggcccccaccccagccgggttctaccacattctgggcctggagtgtcttaagggtcccagcaccacctagcccccagccagccacatacacctgtgttgtgtcccatgaagatagcaggaccctgctaaatgcttctaggagtctggaggtttcctacgtgactgaccatt

SEQ ID NO: 153 - protein, 10 aa, Artificial Sequence
  source: /note="Description of Artificial Sequence: Synthetic peptide"
GGGGSGGGGS

SEQ ID NO: 154 - DNA, 30 bp, Artificial Sequence
  source: /note="Description of Artificial Sequence: Synthetic oligonucleotide"
ggtggcggaggttctggaggtggaggttcc

SEQ ID NO: 155 - protein, 24 aa, Artificial Sequence
  source: /note="Description of Artificial Sequence: Synthetic peptide"
IYIWAPLAGTCGVLLLSLVITLYC

SEQ ID NO: 156 - DNA, 72 bp, Artificial Sequence
  source: /note="Description of Artificial Sequence: Synthetic oligonucleotide"
atctacatctgggcgcccttggccgggacttgtggggtccttctcctgtcactggttatcaccctttactgc

SEQ ID NO: 157 - DNA, 72 bp, Artificial Sequence
  source: /note="Description of Artificial Sequence: Synthetic oligonucleotide"
atctacatttgggcccctctggctggtacttgcggggtcctgctgctttcactcgtgatcactctttactgt

SEQ ID NO: 158 - protein, 42 aa, Artificial Sequence
  source: /note="Description of Artificial Sequence: Synthetic polypeptide"
KRGRKKLLYIFKQPFMRPVQTTQEEDGCSCRFPEEEEGGCEL

SEQ ID NO: 159 - DNA, 126 bp, Artificial Sequence
  source: /note="Description of Artificial Sequence: Synthetic polynucleotide"
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 160 - DNA, 126 bp, Artificial Sequence
  source: /note="Description of Artificial Sequence: Synthetic polynucleotide"
aagcgcggtcggaagaagctgctgtacatctttaagcaacccttcatgaggcctgtgcagactactcaagaggaggacggctgttcatgccggttcccagaggaggaggaaggcggctgcgaactg

SEQ ID NO: 161 - protein, 48 aa, Artificial Sequence
  source: /note="Description of Artificial Sequence: Synthetic polypeptide"
QRRKYRSNKGESPVEPAEPCRYSCPREEEGSTIPIQEDYRKPEPACSP

SEQ ID NO: 162 - DNA, 123 bp, Artificial Sequence
  source: /note="Description of Artificial Sequence: Synthetic polynucleotide"
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 163 - protein, 112 aa, Artificial Sequence
  source: /note="Description of Artificial Sequence: Synthetic polypeptide"
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 164 - DNA, 336 bp, Artificial Sequence
  source: /note="Description of Artificial Sequence: Synthetic polynucleotide"
agagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 165 - DNA, 336 bp, Artificial Sequence
  source: /note="Description of Artificial Sequence: Synthetic polynucleotide"
cgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 166 - protein, 112 aa, Artificial Sequence
  source: /note="Description of Artificial Sequence: Synthetic polypeptide"
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 167 - DNA, 336 bp, Artificial Sequence
  source: /note="Description of Artificial Sequence: Synthetic polynucleotide"
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 168 - protein, 5 aa, Artificial Sequence
  source: /note="Description of Artificial Sequence: Synthetic peptide"
GGGGS

SEQ ID NO: 169 - protein, 150 aa, Artificial Sequence [sequence omitted]

SEQ ID NO: 170 - DNA, 450 bp, Artificial Sequence
  source: /note="Description of Artificial Sequence: Synthetic polynucleotide"
cccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtc

SEQ ID NO: 171 - protein, 394 aa, Artificial Sequence
  source: /note="Description of Artificial Sequence: Synthetic polypeptide"
MALPVTALLLPLALLLHAARPPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 172 - DNA, 1182 bp, Artificial Sequence
  source: /note="Description of Artificial Sequence: Synthetic polynucleotide"
atggccctccctgtcactgccctgcttctccccctcgcactcctgctccacgccgctagaccacccggatggtttctggactctccggatcgcccgtggaatcccccaaccttctcaccggcactcttggttgtgactgagggcgataatgcgaccttcacgtgctcgttctccaacacctccgaatcattcgtgctgaactggtaccgcatgagcccgtcaaaccagaccgacaagctcgccgcgtttccggaagatcggtcgcaaccgggacaggattgtcggttccgcgtgactcaactgccgaatggcagagacttccacatgagcgtggtccgcgctaggcgaaacgactccgggacctacctgtgcggagccatctcgctggcgcctaaggcccaaatcaaagagagcttgagggccgaactgagagtgaccgagcgcagagctgaggtgccaactgcacatccatccccatcgcctcggcctgcggggcagtttcagaccctggtcacgaccactccggcgccgcgcccaccgactccggccccaactatcgcgagccagcccctgtcgctgaggccggaagcatgccgccctgccgccggaggtgctgtgcatacccggggattggacttcgcatgcgacatctacatttgggctcctctcgccggaacttgtggcgtgctccttctgtccctggtcatcaccctgtactgcaagcggggtcggaaaaagcttctgtacattttcaagcagcccttcatgaggcccgtgcaaaccacccaggaggaggacggttgctcctgccggttccccgaagaggaagaaggaggttgcgagctgcgcgtgaagttctcccggagcgccgacgcccccgcctataagcagggccagaaccagctgtacaacgaactgaacctgggacggcgggaagagtacgatgtgctggacaagcggcgcggccgggaccccgaaatgggcgggaagcctagaagaaagaaccctcaggaaggcctgtataacgagctgcagaaggacaagatggccgaggcctactccgaaattgggatgaagggagagcggcggaggggaaaggggcacgacggcctgtaccaaggactgtccaccgccaccaaggacacatacgatgccctgcacatgcaggcccttccccctcgc

SEQ ID NO: 173 - protein, 40 aa, Artificial Sequence
  source: /note="Description of Artificial Sequence: Synthetic polypeptide"
  SITE (1)..(40): /note="This sequence may encompass 1-10 'Gly Gly Gly Ser' repeating units"
GGGSGGGSGGGSGGGSGGGSGGGSGGGSGGGSGGGSGGGS

SEQ ID NO: 174 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 175 - protein, 373 aa, Artificial Sequence
  source: /note="Description of Artificial Sequence: Synthetic polypeptide"
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 176 - protein, 35 aa, Artificial Sequence
  source: /note="Description of Artificial Sequence: Synthetic polypeptide"
TKKKYSSSVHDPNGEYMFMRAVNTAKKSRLTDVTL

SEQ ID NO: 177 - DNA, 105 bp, Artificial Sequence
  source: /note="Description of Artificial Sequence: Synthetic polynucleotide"
acaaaaaagaagtattcatccagtgtgcacgaccctaacggtgaatacatgttcatgagagcagtgaacacagccaaaaaatccagactcacagatgtgacccta

SEQ ID NO: 178 - protein, 69 aa, Artificial Sequence
  source: /note="Description of Artificial Sequence: Synthetic polypeptide"
TTTPAPRPPTPAPTIASQPLSLRPEACRPAAGGAVHTRGLDFACDFWLPIGCAAFVVVCILGCILICWL

SEQ ID NO: 179 - DNA, 207 bp, Artificial Sequence
  source: /note="Description of Artificial Sequence: Synthetic polynucleotide"
accacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatttctggttacccataggatgtgcagcctttgttgtagtctgcattttgggatgcatacttatttgttggctt

SEQ ID NO: 180 - protein, 41 aa, Artificial Sequence
  source: /note="Description of Artificial Sequence: Synthetic polypeptide"
RSKRSRLLHSDYMNMTPRRPGPTRKHYQPYAPPRDFAAYRS

SEQ ID NO: 181 - protein, 486 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 182 - protein, 465 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 183 - protein, 486 aa, Artificial Sequence; identical to SEQ ID NO: 181
  source: /note="Description of Artificial Sequence: Synthetic polypeptide"

SEQ ID NO: 184 - DNA, 1458 bp, Artificial Sequence
  source: /note="Description of Artificial Sequence: Synthetic polynucleotide"
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 185 - protein, 242 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 186 - protein, 244 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRS

SEQ ID NO: 187 - protein, 464 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVTGGGSGGGSGGGSGGGSELVLTQSPKFMSTSVGDRVSVTCKASQNVGTNVAWYQQKPGQSPKPLIYSATYRNSGVPDRFTGSGSGTDFTLTITNVQSKDLADYFCQYNRYPYTSFFFTKLEIKRRSKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 188 - protein, 246 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSE

SEQ ID NO: 189 - protein, 439 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRL

SEQ ID NO: 190 - protein, 819 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSESKYGPPCPPCPMFWVLVVVGGVLACYSLLVTVAFIIFWVKRGRKKLLYIFKQPFMRPVQTTQEEDGCSCRFEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRLEGGGEGRGSLLTCGDVEENPGPRMLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 191 - protein, 245 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 192 - protein, 467 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 193 - protein, 119 aa, Artificial Sequence
  source: /note="Description of Artificial Sequence: Synthetic polypeptide"
QVQLLESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDYWGQGTTVT

SEQ ID NO: 194 - protein, 111 aa, Artificial Sequence
  source: /note="Description of Artificial Sequence: Synthetic polypeptide"
ELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 195 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 196 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 197 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 198 - DNA, 813 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagccaccaccatcatcaccatcaccat

SEQ ID NO: 199 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 200 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaaattgtgatgacccagtcacccgccactcttagcctttcacccggtgagcgcgcaaccctgtcttgcagagcctcccaagacatctcaaaataccttaattggtatcaacagaagcccggacaggctcctcgccttctgatctaccacaccagccggctccattctggaatccctgccaggttcagcggtagcggatctgggaccgactacaccctcactatcagctcactgcagccagaggacttcgctgtctatttctgtcagcaagggaacaccctgccctacacctttggacagggcaccaagctcgagattaaaggtggaggtggcagcggaggaggtgggtccggcggtggaggaagccaggtccaactccaagaaagcggaccgggtcttgtgaagccatcagaaactctttcactgacttgtactgtgagcggagtgtctctccccgattacggggtgtcttggatcagacagccaccggggaagggtctggaatggattggagtgatttggggctctgagactacttactaccaatcatccctcaagtcacgcgtcaccatctcaaaggacaactctaagaatcaggtgtcactgaaactgtcatctgtgaccgcagccgacaccgccgtgtactattgcgctaagcattactattatggcgggagctacgcaatggattactggggacagggtactctggtcaccgtgtccagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 201 - protein, 271 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 202 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 203 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 204 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 205 - protein, 486 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 207 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 209 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 210 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 211 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 212 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 213 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 214 - protein, 247 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 215 - protein, 491 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 216 - protein, 247 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 217 - protein, 242 aa, Artificial Sequence
  source: /note="Description of Artificial Sequence: Synthetic polypeptide"
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 218 - protein, 491 aa, Artificial Sequence
  source: /note="Description of Artificial Sequence: Synthetic polypeptide"
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 219 - protein, 242 aa, Artificial Sequence
  source: /note="Description of Artificial Sequence: Synthetic polypeptide"
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 220 - protein, 486 aa, Artificial Sequence
  source: /note="Description of Artificial Sequence: Synthetic polypeptide"
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 221 - protein, 5 aa, Artificial Sequence
  source: /note="Description of Artificial Sequence: Synthetic peptide"
DYGVS

SEQ ID NO: 222 - protein, 16 aa, Artificial Sequence
  source: /note="Description of Artificial Sequence: Synthetic peptide"
VIWGSETTYYNSALKS

SEQ ID NO: 223 - protein, 12 aa, Artificial Sequence
  source: /note="Description of Artificial Sequence: Synthetic peptide"
HYYYGGSYAMDY

SEQ ID NO: 224 - protein, 11 aa, Artificial Sequence
  source: /note="Description of Artificial Sequence: Synthetic peptide"
RASQDISKYLN

SEQ ID NO: 225 - protein, 7 aa, Artificial Sequence
  source: /note="Description of Artificial Sequence: Synthetic peptide"
HTSRLHS

SEQ ID NO: 226 - protein, 9 aa, Artificial Sequence
  source: /note="Description of Artificial Sequence: Synthetic peptide"
QQGNTLPYT

SEQ ID NO: 227 - protein, 16 aa, Artificial Sequence
  source: /note="Description of Artificial Sequence: Synthetic peptide"
VIWGSETTYYSSSLKS

SEQ ID NO: 228 - protein, 16 aa, Artificial Sequence
  source: /note="Description of Artificial Sequence: Synthetic peptide"
VIWGSETTYYQSSLKS

SEQ ID NO: 229 - protein, 16 aa, Artificial Sequence
  source: /note="Description of Artificial Sequence: Synthetic peptide"
VIWGSETTYYNSSLKS

SEQ ID NO: 230 - protein, 10 aa, Artificial Sequence
  source: /note="Description of Artificial Sequence: Synthetic peptide"
GVSLPDYGVS

SEQ ID NO: 231 - protein, 10 aa, Artificial Sequence
  source: /note="Description of Artificial Sequence: Synthetic peptide"
GYTFTGYYMH

SEQ ID NO: 232 - protein, 10 aa, Artificial Sequence
  source: /note="Description of Artificial Sequence: Synthetic peptide"
GYIFTGYYIH

SEQ ID NO: 233 - protein, 10 aa, Artificial Sequence
  source: /note="Description of Artificial Sequence: Synthetic peptide"
GYTFTDYYMH

SEQ ID NO: 234 - protein, 17 aa, Artificial Sequence
  source: /note="Description of Artificial Sequence: Synthetic peptide"
WINPNSGGTNYAQKFQG

SEQ ID NO: 235 - protein, 17 aa, Artificial Sequence
  source: /note="Description of Artificial Sequence: Synthetic peptide"
WINPNSGDTNYAQKFQG

SEQ ID NO: 236 - protein, 12 aa, Artificial Sequence
  source: /note="Description of Artificial Sequence: Synthetic peptide"
DMNILATVPFDI

SEQ ID NO: 237 - protein, 11 aa, Artificial Sequence
  source: /note="Description of Artificial Sequence: Synthetic peptide"
RASQSISSYLN

SEQ ID NO: 238 - protein, 11 aa, Artificial Sequence
  source: /note="Description of Artificial Sequence: Synthetic peptide"
RASQSISTYLN

SEQ ID NO: 239 - protein, 7 aa, Artificial Sequence
  source: /note="Description of Artificial Sequence: Synthetic peptide"
AAFSLQS

SEQ ID NO: 240 - protein, 7 aa, Artificial Sequence
  source: /note="Description of Artificial Sequence: Synthetic peptide"
AASSLQS

SEQ ID NO: 241 - protein, 9 aa, Artificial Sequence
  source: /note="Description of Artificial Sequence: Synthetic peptide"
QQGDSVPLT

SEQ ID NO: 242 - protein, 10 aa, Artificial Sequence
  source: /note="Description of Artificial Sequence: Synthetic peptide"
GYTFTSYWMN

SEQ ID NO: 243 - protein, 17 aa, Artificial Sequence
  source: /note="Description of Artificial Sequence: Synthetic peptide"
RIDPYDSETHYNQKFKD

SEQ ID NO: 244 - protein, 6 aa, Artificial Sequence
  source: /note="Description of Artificial Sequence: Synthetic peptide"
GNWDDY

SEQ ID NO: 245 - protein, 11 aa, Artificial Sequence
  source: /note="Description of Artificial Sequence: Synthetic peptide"
RASKSISKDLA

SEQ ID NO: 246 - protein, 7 aa, Artificial Sequence
  source: /note="Description of Artificial Sequence: Synthetic peptide"
SGSTLQS

SEQ ID NO: 247 - protein, 9 aa, Artificial Sequence
  source: /note="Description of Artificial Sequence: Synthetic peptide"
QQHNKYPYT

SEQ ID NO: 248 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 249 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 250 - protein, 264 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 251 - protein, 121 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSS

SEQ ID NO: 252 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 253 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgttcaatccggcgcagaagtcaagaagccaggagcatcagtgaaagtgtcctgcaaagcctcaggctacatcttcacgggatactacatccactgggtgcgccaggctccgggccagggccttgagtggatgggctggatcaaccctaactctgggggaaccaactacgctcagaagttccaggggagggtcactatgactcgcgatacctccatctccactgcgtacatggaactctcgggactgagatccgacgatcctgccgtgtactactgcgcccgggacatgaacatcttggcgaccgtgccgtttgacatttggggacagggcaccctcgtcactgtgtcgagcggtggaggaggctcggggggtggcggatcaggagggggaggaagcgacatccagctgactcagagcccatcgtcgttgtccgcgtcggtgggggatagagtgaccattacttgccgcgccagccagagcatctcatcatatctgaattggtaccagcagaagcccggaaaggccccaaaactgctgatctacgctgcaagcagcctccaatcgggagtgccgtcacggttctccgggtccggttcgggaactgactttaccctgaccgtgaattcgctgcaaccggaggatttcgccacgtactactgtcagcaaggagactccgtgccgctgaccttcggtggaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 254 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 255 - protein, 264 aa, Artificial Sequence
  source: /note="Description of Artificial Sequence: Synthetic polypeptide"
MALPVTALLLPLALLLHAARPQVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 256 - protein, 121 aa, Artificial Sequence
  source: /note="Description of Artificial Sequence: Synthetic polypeptide"
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSS

SEQ ID NO: 257 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 258 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtccaactccaacagtcaggcgcagaagtgaaaaagagcggtgcatcggtgaaagtgtcatgcaaagcctcgggctacaccttcactgactactatatgcactggctgcggcaggcaccgggacagggacttgagtggatgggatggatcaacccgaattcaggggacactaactacgcgcagaagttccaggggagagtgaccctgacgagggacacctcaatttcgaccgtctacatggaattgtcgcgcctgagatcggacgatactgctgtgtactactgtgcccgcgacatgaacatcctcgcgactgtgccttttgatatctggggacaggggactatggtcaccgtttcctccgcttccggtggcggaggctcgggaggccgggcctccggtggaggaggcagcgacatccagatgactcagagcccttcctcgctgagcgcctcagtgggagatcgcgtgaccatcacttgccgggccagccagtccatttcgtcctacctcaattggtaccagcagaagccgggaaaggcgcccaagctcttgatctacgctgcgagctccctgcaaagcggggtgccgagccgattctcgggttccggctcgggaaccgacttcactctgaccatctcatccctgcaaccagaggactttgccacctactactgccaacaaggagattctgtcccactgacgttcggcggaggaaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 259 - protein, 336 aa, Artificial Sequence
  source: /note="Description of Artificial Sequence: Synthetic polypeptide"
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIKTTTPAPRPPTPAPTIASQPLSLRPEACRPAAGGAVHTRGLDFACDIYIWAPLAGTCGVLLLSLVITLYCK

SEQ ID NO: 260 - protein, 266 aa, Artificial Sequence
  source: /note="Description of Artificial Sequence: Synthetic polypeptide"
MALPVTALLLPLALLLHAARPQVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 261 - protein, 121 aa, Artificial Sequence
  source: /note="Description of Artificial Sequence: Synthetic polypeptide"
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSS

SEQ ID NO: 262 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 263 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtcaggagcggaagtcaagaagcccggagcgtcagtcaaagtgtcatgcaaagcctcgggctacactttcactgggtactacatgcactgggtgcgccaggctccaggacagggactggaatggatgggatggatcaacccgaactccggtggcaccaattacgcccagaagttccaggggagggtgaccatgactcgcgacacgtcgatcagcaccgcatacatggagctgtcaagactccggtccgacgatactgccgtgtactactgcgcacgggacatgaacattctggccaccgtgccttttgacatctggggtcagggaactatggttaccgtgtcctctggtggaggcggctccggcggggggggaagcggaggcggtggaagcgacattcagatgacccagtcgccttcatccctttcggcgagcgtgggagatcgcgtcactatcacttgtcgggcctcgcagtccatctccacctacctcaattggtaccagcagaagccaggaaaagcaccgaatctgctgatctacgccgcgttttccttgcaatcgggagtgccaagcagattcagcggatcgggatcaggcactgatttcaccctcaccatcaactcgctgcaaccggaggatttcgctacgtactattgccaacaaggagacagcgtgccgctcaccttcggcggagggactaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 264 - protein, 487 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 265 - protein, 264 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 266 - protein, 121 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSS

SEQ ID NO: 267 - protein, 107 aa, Artificial Sequence
  source: /note="Description of Artificial Sequence: Synthetic polypeptide"
DIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 268 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 269 - protein, 486 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 270 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 271 - protein, 115 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 272 - protein, 107 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 273 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 274 - protein, 486 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 275 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 276 - protein, 107 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 277 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 278 - protein, 486 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 279 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 280 - protein, 107 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 281 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 282 - protein, 486 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 283 - protein, 263 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 284 - protein, 107 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 285 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 286 - protein, 486 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 287 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 288 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 289 - protein, 486 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 290 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 291 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 292 - protein, 486 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 293 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 294 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagccaagtgcagctggtccagtcgggagccgaagtcaagaagcccggcgctagcgtgaaagtgtcctgcaaagcctccgggtacacattcacctcctactggatgaattgggtcagacaggcgcccggccagggactcgagtggatgggaaggattgatccttacgactccgaaacccattacaaccagaagttcaaggaccgcgtgaccatgactgtggataagtccacttccaccgcttacatggagctgtccagcctgcgctccgaggataccgcagtgtactactgcgcccggggaaactgggacgactattggggacagggaactaccgtgaccgtgtcaagcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 295 - protein, 486 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 296 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 297 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 298 - protein, 486 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 299 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 300 - protein, 115 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 301 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 302 - protein, 486 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 303 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 304 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 305 - protein, 486 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 306 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 307 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 308 - protein, 486 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 309 - protein, 263 aa, Artificial Sequence
  source: /note="Description of Artificial Sequence: Synthetic polypeptide"
MALPVTALLLPLALLLHAARPQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 310 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 311 - protein, 486 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 312 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 313 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 314 - protein, 486 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 315 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 316 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 317 - protein, 486 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 318 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 319 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagccaagtgcagctggtgcagtcaggcagcgaactgaagaagcccggagcctccgtcaaagtgtcctgcaaagcctcgggatacaccttcacctcctactggatgaactgggtccgccaggcacctggacaggggctggagtggatgggaaggatcgatccctacgattccgaaacccattacaatcagaagttcaaggaccggtttgtgttctccgtggacaagtccgtgtccaccgcctacctccaaattagcagcctgaaggcggaggatacagctgtctactactgcgctcgcggaaactgggatgactattggggccagggaactaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 320 - protein, 486 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 321 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 322 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 323 - protein, 486 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 324 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 325 - protein, 115 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 326 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 327 - protein, 486 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 328 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 329 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 330 - protein, 486 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 331 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 332 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 333 - protein, 486 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 334 - protein, 263 aa, Artificial Sequence
  source: /note="Description of Artificial Sequence: Synthetic polypeptide"
MALPVTALLLPLALLLHAARPEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 335 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 336 - protein, 486 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 337 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 338 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 339 - protein, 486 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 340 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 341 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 342 - protein, 486 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 343 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 344 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagcgaggtgcagctggtgcagagcggagccgaggtcaagaagcctggagaatccctgaggatcagctgcaaaggcagcgggtataccttcacctcctactggatgaattgggtccgccagatgcccggaaaaggcctggagtggatgggacggattgacccctacgactcggaaacccattacaaccagaagttcaaggatcacgtgaccatctccgtggacaagtccatttccactgcgtacctccagtggtcaagcctgaaggcctccgacactgctatgtactactgcgcacgcggaaactgggatgattactggggacagggaacaaccgtgactgtgtcctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 345 - protein, 486 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 346 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 347 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 348 - protein, 486 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 349 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 350 - protein, 115 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 351 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 352 - protein, 486 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 353 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 354 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 355 - protein, 486 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 356 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 357 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccgggggtggcggtagcggaggagggggctccggcggcggcggctcagggggcggaggaagcgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 358 - protein, 486 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 359 - protein, 263 aa, Artificial Sequence
  source: /note="Description of Artificial Sequence: Synthetic polypeptide"
MALPVTALLLPLALLLHAARPEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 360 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtgcagctcacccagtcgccctcatttctgtcggcctcagtgggagacagagtgaccattacttgtcgggcctccaagagcatctccaaggacctggcctggtatcagcagaagccaggaaaggcgcctaagttgctcatctactcggggtcgaccctgcaatctggcgtgccgtcccggttctccggttcgggaagcggtaccgaattcacccttactatctcctccctgcaaccggaggacttcgccacctactactgccaacagcacaacaagtacccgtacactttcgggggtggcacgaaggtcgaaatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 361 - protein, 486 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 362 - protein, 263 aa, Artificial Sequence
  source: /note="Description of Artificial Sequence: Synthetic polypeptide"
MALPVTALLLPLALLLHAARPDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 363 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtggtgctgacccagtcgcccgcaaccctctctctgtcgccgggagaacgcgccactctttcctgtcgggcgtccaagagcatctcaaaggacctcgcctggtaccagcagaagcctggtcaagccccgcggctgctgatctactccggctccacgctgcaatcaggaatcccagccagattttccggttcggggtcggggactgacttcaccttgaccattagctcgctggaacctgaggacttcgccgtgtattactgccagcagcacaacaagtacccgtacaccttcggaggcggtactaaggtcgagatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 364 - protein, 486 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 365 - protein, 263 aa, Artificial Sequence
  source: /note="Description of Artificial Sequence: Synthetic polypeptide"
MALPVTALLLPLALLLHAARPEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 366 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtgatgacccagtcaccggcattcctgtccgtgactcccggagaaaaggtcacgattacttgccgggcgtccaagagcatctccaaggacctcgcctggtaccaacagaagccggaccaggcccctaagctgttgatctactcggggtccacccttcaatcgggagtgccatcgcggtttagcggttcgggttctgggaccgacttcactttcaccatctcctcactggaagccgaggatgccgccacttactactgtcagcagcacaacaagtatccgtacaccttcggaggcggtaccaaagtggagatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 367 - protein, 486 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 368 - protein, 263 aa, Artificial Sequence
  source: /note="Description of Artificial Sequence: Synthetic polypeptide"
MALPVTALLLPLALLLHAARPDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 369 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcagtccccggactcactcgcggtgtcgcttggagagagagcgaccatcaactgtcgggcctcaaagagcatcagcaaggacctggcctggtaccagcagaagccgggacagccgccaaagctgctgatctactccgggtccaccttgcaatctggtgtccctgaccggttctccggttccgggtcgggtaccgacttcacgctcactatttcgtcgctgcaagccgaagatgtggccgtgtactattgccaacagcacaacaagtacccctacacttttggcggaggcaccaaggtggaaatcaaggggggtggcggtagcggaggagggggctccggcggcggcggctcagggggcggaggaagcgaagtgcagctcgtcgagagcggagggggactggtgcagcccggaggaagcctgaggctgtcctgcgctgcctccggctacaccttcacctcctactggatgaactgggtcagacaggcacctggaaagggactggtctgggtgtcgcgcattgacccctacgactccgaaacccattacaatcagaaattcaaggaccgcttcaccatctccgtggacaaagccaagagcaccgcgtacctccaaatgaactccctgcgcgctgaggatacagcagtgtactattgcgcccggggaaactgggatgattactggggccagggaactactgtgactgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 370 - protein, 486 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 371 - protein, 263 aa, Artificial Sequence
  source: /note="Description of Artificial Sequence: Synthetic polypeptide"
MALPVTALLLPLALLLHAARPDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 372 - DNA, 729 bp, Artificial Sequence
  source: /note="Description of Artificial Sequence: Synthetic polynucleotide"
caagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaag

SEQ ID NO: 373 - protein, 243 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTLTRDTSISTVYMELSRLRSDDTAVYYCARDMNILATVPFDIWGQGTMVTVSSGGGGSGGGGSGGGGSDIQMTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTRLEIK

SEQ ID NO: 374 - DNA, 1760 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtccaaagcggagcggaagtcaagaaacccggagcgagcgtgaaagtgtcctgcaaagcctccggctacacctttacgggctactacatgcactgggtgcgccaggcaccaggacagggtcttgaatggatgggatggatcaaccctaattcgggcggaactaactacgcacagaagttccaggggagagtgactctgactcgggatacctccatctcaactgtctacatggaactctcccgcttgcggtcagatgatacggcagtgtactactgcgcccgcgacatgaatatcctggctaccgtgccgttcgacatctggggacaggggactatggttactgtctcatcgggcggtggaggttcaggaggaggcggctcgggaggcggaggttcggacattcagatgacccagtccccatcctctctgtcggccagcgtcggagatagggtgaccattacctgtcgggcctcgcaaagcatctcctcgtacctcaactggtatcagcaaaagccgggaaaggcgcctaagctgctgatctacgccgcttcgagcttgcaaagcggggtgccatccagattctcgggatcaggctcaggaaccgacttcaccctgaccgtgaacagcctccagccggaggactttgccacttactactgccagcagggagactccgtgccgcttactttcggggggggtacccgcctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcttgccggttcccagaggaggaggaaggcggctgcgaactgcgcgtgaaattcagccgcagcgcagacgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcggtaagtcgacagctcgctttcttgctgtccaatttctattaaaggttcctttgttccctaagtccaactactaaactgggggatattatgaagggccttgagcatctggattctgcctaataaaaaacatttattttcattgctgcgtcgagagctcgctttcttgctgtccaatttctattaaaggttcctttgttccctaagtccaactactaaactgggggatattatgaagggccttgagcatctggattctgcctaataaaaaacatttattttcattgctgcctcgacgaattc

SEQ ID NO: 375 - DNA, 729 bp, Artificial Sequence
  source: /note="Description of Artificial Sequence: Synthetic polynucleotide"
caagtccaactcgttcaatccggcgcagaagtcaagaagccaggagcatcagtgaaagtgtcctgcaaagcctcaggctacatcttcacgggatactacatccactgggtgcgccaggctccgggccagggccttgagtggatgggctggatcaaccctaactctgggggaaccaactacgctcagaagttccaggggagggtcactatgactcgcgatacctccatctccactgcgtacatggaactctcgggactgagatccgacgatcctgccgtgtactactgcgcccgggacatgaacatcttggcgaccgtgccgtttgacatttggggacagggcaccctcgtcactgtgtcgagcggtggaggaggctcggggggtggcggatcaggagggggaggaagcgacatccagctgactcagagcccatcgtcgttgtccgcgtcggtgggggatagagtgaccattacttgccgcgccagccagagcatctcatcatatctgaattggtaccagcagaagcccggaaaggccccaaaactgctgatctacgctgcaagcagcctccaatcgggagtgccgtcacggttctccgggtccggttcgggaactgactttaccctgaccgtgaattcgctgcaaccggaggatttcgccacgtactactgtcagcaaggagactccgtgccgctgaccttcggtggaggcaccaaggtcgaaatcaag

SEQ ID NO: 376 - protein, 243 aa, Artificial Sequence
  source: /note="Description of Artificial Sequence: Synthetic polypeptide"
QVQLVQSGAEVKKPGASVKVSCKASGYIFTGYYIHWVRQAPGQGLEWMGWINPNSGGTNYAQKFQGRVTMTRDTSISTAYMELSGLRSDDPAVYYCARDMNILATVPFDIWGQGTLVTVSSGGGGSGGGGSGGGGSDIQLTQSPSSLSASVGDRVTITCRASQSISSYLNWYQQKPGKAPKLLIYAASSLQSGVPSRFSGSGSGTDFTLTVNSLQPEDFATYYCQQGDSVPLTFGGGTKVEIK

SEQ ID NO: 377 - DNA, 735 bp, Artificial Sequence
  source: /note="Description of Artificial Sequence: Synthetic polynucleotide"
caagtccaactccaacagtcaggcgcagaagtgaaaaagagcggtgcatcggtgaaagtgtcatgcaaagcctcgggctacaccttcactgactactatatgcactggctgcggcaggcaccgggacagggacttgagtggatgggatggatcaacccgaattcaggggacactaactacgcgcagaagttccaggggagagtgaccctgacgagggacacctcaatttcgaccgtctacatggaattgtcgcgcctgagatcggacgatactgctgtgtactactgtgcccgcgacatgaacatcctcgcgactgtgccttttgatatctggggacaggggactatggtcaccgtttcctccgcttccggtggcggaggctcgggaggccgggcctccggtggaggaggcagcgacatccagatgactcagagcccttcctcgctgagcgcctcagtgggagatcgcgtgaccatcacttgccgggccagccagtccatttcgtcctacctcaattggtaccagcagaagccgggaaaggcgcccaagctcttgatctacgctgcgagctccctgcaaagcggggtgccgagccgattctcgggttccggctcgggaaccgacttcactctgaccatctcatccctgcaaccagaggactttgccacctactactgccaacaaggagattctgtcccactgacgttcggcggaggaaccaaggtcgaaatcaag

SEQ ID NO: 378 - protein, 245 aa, Artificial Sequence
  source: /note="Description of Artificial Sequence: Synthetic polypeptide"
QVQLQQSGAEVKKSGASVKVSCKASGYTFTDYYMHWLRQAPGQGLEWMGWINPNSGDTNYAQKFQGRVTLTRDTSISTVYMELSRLRSDDTAVYYCARDMNILATVPFDIWGQGTMVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQGDSVPLTFGGGTKVEIK

SEQ ID NO: 379 - protein, 243 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDMNILATVPFDIWGQGTMVTVSSGGGGSGGGGSGGGGSDIQMTQSPSSLSASVGDRVTITCRASQSISTYLNWYQQKPGKAPNLLIYAAFSLQSGVPSRFSGSGSGTDFTLTINSLQPEDFATYYCQQGDSVPLTFGGGTKLEIK

SEQ ID NO: 380 - protein, 242 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 381 - protein, 242 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 382 - protein, 242 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 383 - protein, 242 aa, Artificial Sequence
  source: /note="Description of Artificial Sequence: Synthetic polypeptide"
QVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 384 - protein, 242 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 385 - protein, 242 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 386 - protein, 242 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 387 - protein, 242 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGAEVKKPGASVKVSCKASGYTFTSYWMNWVRQAPGQGLEWMGRIDPYDSETHYNQKFKDRVTMTVDKSTSTAYMELSSLRSEDTAVYYCARGNWDDYWGQGTTVTVSS

SEQ ID NO: 388 - protein, 242 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 389 - protein, 242 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 390 - protein, 242 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 391 - protein, 242 aa, Artificial Sequence
  source: /note="Description of Artificial Sequence: Synthetic polypeptide"
QVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 392 - protein, 242 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 393 - protein, 242 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 394 - protein, 242 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 395 - protein, 242 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSQVQLVQSGSELKKPGASVKVSCKASGYTFTSYWMNWVRQAPGQGLEWMGRIDPYDSETHYNQKFKDRFVFSVDKSVSTAYLQISSLKAEDTAVYYCARGNWDDYWGQGTTVTVSS

SEQ ID NO: 396 - protein, 242 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 397 - protein, 242 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 398 - protein, 242 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 399 - protein, 242 aa, Artificial Sequence
  source: /note="Description of Artificial Sequence: Synthetic polypeptide"
EVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 400 - protein, 242 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 401 - protein, 242 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 402 - protein, 242 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 403 - protein, 242 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVQSGAEVKKPGESLRISCKGSGYTFTSYWMNWVRQMPGKGLEWMGRIDPYDSETHYNQKFKDHVTISVDKSISTAYLQWSSLKASDTAMYYCARGNWDDYWGQGTTVTVSS

SEQ ID NO: 404 - protein, 242 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIK

SEQ ID NO: 405 - protein, 242 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSEVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIK

SEQ ID NO: 406 - protein, 242 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIK

SEQ ID NO: 407 - protein, 242 aa, Artificial Sequence
  source: /note="Description of Artificial Sequence: Synthetic polypeptide"
EVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSSGGGGSGGGGSGGGGSGGGGSDVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIK

SEQ ID NO: 408 - protein, 242 aa, Artificial Sequence
  source: /note="Description of Artificial Sequence: Synthetic polypeptide"
DVQLTQSPSFLSASVGDRVTITCRASKSISKDLAWYQQKPGKAPKLLIYSGSTLQSGVPSRFSGSGSGTEFTLTISSLQPEDFATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 409 - protein, 242 aa, Artificial Sequence
  source: /note="Description of Artificial Sequence: Synthetic polypeptide"
EVVLTQSPATLSLSPGERATLSCRASKSISKDLAWYQQKPGQAPRLLIYSGSTLQSGIPARFSGSGSGTDFTLTISSLEPEDFAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 410 - protein, 242 aa, Artificial Sequence
  source: /note="Description of Artificial Sequence: Synthetic polypeptide"
DVVMTQSPAFLSVTPGEKVTITCRASKSISKDLAWYQQKPDQAPKLLIYSGSTLQSGVPSRFSGSGSGTDFTFTISSLEAEDAATYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 411 - protein, 242 aa, Artificial Sequence
  source: /note="Description of Artificial Sequence: Synthetic polypeptide"
DVVMTQSPDSLAVSLGERATINCRASKSISKDLAWYQQKPGQPPKLLIYSGSTLQSGVPDRFSGSGSGTDFTLTISSLQAEDVAVYYCQQHNKYPYTFGGGTKVEIKGGGGSGGGGSGGGGSGGGGSEVQLVESGGGLVQPGGSLRLSCAASGYTFTSYWMNWVRQAPGKGLVWVSRIDPYDSETHYNQKFKDRFTISVDKAKSTAYLQMNSLRAEDTAVYYCARGNWDDYWGQGTTVTVSS

SEQ ID NO: 412 - protein, 5 aa, Artificial Sequence
  source: /note="Description of Artificial Sequence: Synthetic peptide"
NHGMS

SEQ ID NO: 413 - protein, 5 aa, Artificial Sequence
  source: /note="Description of Artificial Sequence: Synthetic peptide"
NYAMS

SEQ ID NO: 414 - protein, 5 aa, Artificial Sequence
  source: /note="Description of Artificial Sequence: Synthetic peptide"
DYAMH

SEQ ID NO: 415 - protein, 5 aa, Artificial Sequence
  source: /note="Description of Artificial Sequence: Synthetic peptide"
NFGIN

SEQ ID NO: 416 - protein, 5 aa, Artificial Sequence
  source: /note="Description of Artificial Sequence: Synthetic peptide"
SDAMT

SEQ ID NO: 417 - protein, 5 aa, Artificial Sequence
  source: /note="Description of Artificial Sequence: Synthetic peptide"
NYGIT

SEQ ID NO: 418 - protein, 5 aa, Artificial Sequence
  source: /note="Description of Artificial Sequence: Synthetic peptide"
DYYMS

SEQ ID NO: 419 - protein, 7 aa, Artificial Sequence
  source: /note="Description of Artificial Sequence: Synthetic peptide"
SSYYYWG

SEQ ID NO: 420 - protein, 7 aa, Artificial Sequence
  source: /note="Description of Artificial Sequence: Synthetic peptide"
TSGMCVS

SEQ ID NO: 421 - protein, 5 aa, Artificial Sequence
  source: /note="Description of Artificial Sequence: Synthetic peptide"
SYSMN

SEQ ID NO: 422 - protein, 5 aa, Artificial Sequence
  source: /note="Description of Artificial Sequence: Synthetic peptide"
SHYIH

SEQ ID NO: 423 - protein, 7 aa, Artificial Sequence
  source: /note="Description of Artificial Sequence: Synthetic peptide"
SGGYYWS

SEQ ID NO: 424 - protein, 5 aa, Artificial Sequence
  source: /note="Description of Artificial Sequence: Synthetic peptide"
SYAIS

SEQ ID NO: 425 - protein, 7 aa, Artificial Sequence
  source: /note="Description of Artificial Sequence: Synthetic peptide"
SNSAAWN

SEQ ID NO: 426 - protein, 5 aa, Artificial Sequence
  source: /note="Description of Artificial Sequence: Synthetic peptide"
SYAMS

SEQ ID NO: 427 - protein, 5 aa, Artificial Sequence
  source: /note="Description of Artificial Sequence: Synthetic peptide"
RYPMS

SEQ ID NO: 428 - protein, 5 aa, Artificial Sequence
  source: /note="Description of Artificial Sequence: Synthetic peptide"
NFGMN

SEQ ID NO: 429 - protein, 5 aa, Artificial Sequence
  source: /note="Description of Artificial Sequence: Synthetic peptide"
DYSIN

SEQ ID NO: 430 - protein, 5 aa, Artificial Sequence
  source: /note="Description of Artificial Sequence: Synthetic peptide"
HYSMN

SEQ ID NO: 431 - protein, 16 aa, Artificial Sequence
  source: /note="Description of Artificial Sequence: Synthetic peptide"
GIVYSGSTYYAASVKG

SEQ ID NO: 432 - protein, 17 aa, Artificial Sequence
  source: /note="Description of Artificial Sequence: Synthetic peptide"
GISRSGENTYYADSVKG

SEQ ID NO: 433 - protein, 17 aa, Artificial Sequence
  source: /note="Description of Artificial Sequence: Synthetic peptide"
GISWNSGSIGYADSVKG

SEQ ID NO: 434 - protein, 17 aa, Artificial Sequence
  source: /note="Description of Artificial Sequence: Synthetic peptide"
WINPKNNNTNYAQKFQG

SEQ ID NO: 435 - protein, 17 aa, Artificial Sequence
  source: /note="Description of Artificial Sequence: Synthetic peptide"
VISGSGGTTYYADSVKG

SEQ ID NO: 436 - protein, 17 aa, Artificial Sequence
  source: /note="Description of Artificial Sequence: Synthetic peptide"
WISAYNGNTNYAQKFQG

SEQ ID NO: 437 - protein, 17 aa, Artificial Sequence
  source: /note="Description of Artificial Sequence: Synthetic peptide"
YISSSGSTIYYADSVKG

SEQ ID NO: 438 - protein, 17 aa, Artificial Sequence
  source: /note="Description of Artificial Sequence: Synthetic peptide"
YISSSGNTIYYADSVKG

SEQ ID NO: 439 - protein, 16 aa, Artificial Sequence
  source: /note="Description of Artificial Sequence: Synthetic peptide"
SIYYSGSAYYNPSLKS

SEQ ID NO: 440 - protein, 16 aa, Artificial Sequence
  source: /note="Description of Artificial Sequence: Synthetic peptide"
RIDWDEDKFYSTSLKT

SEQ ID NO: 441 - protein, 17 aa, Artificial Sequence
  source: /note="Description of Artificial Sequence: Synthetic peptide"
SISSSSSYIYYADSVKG

SEQ ID NO: 442 - protein, 17 aa, Artificial Sequence
  source: /note="Description of Artificial Sequence: Synthetic peptide"
MINPSGGVTAYSQTLQG

SEQ ID NO: 443 - protein, 16 aa, Artificial Sequence
  source: /note="Description of Artificial Sequence: Synthetic peptide"
YIYYSGSTYYNPSLKS

SEQ ID NO: 444 - protein, 17 aa, Artificial Sequence
  source: /note="Description of Artificial Sequence: Synthetic peptide"
GIIPIFGTANYAQKFQG

SEQ ID NO: 445 - protein, 18 aa, Artificial Sequence
  source: /note="Description of Artificial Sequence: Synthetic peptide"
RTYYRSKWYSFYAISLKS

SEQ ID NO: 446 - protein, 17 aa, Artificial Sequence
  source: /note="Description of Artificial Sequence: Synthetic peptide"
AISGSGGSTYYADSVKG

SEQ ID NO: 447 - protein, 17 aa, Artificial Sequence
  source: /note="Description of Artificial Sequence: Synthetic peptide"
GISDSGVSTYYADSAKG

SEQ ID NO: 448 - protein, 17 aa, Artificial Sequence
  source: /note="Description of Artificial Sequence: Synthetic peptide"
SINWKGNSLAYGDSVKG

SEQ ID NO: 449 - protein, 17 aa, Artificial Sequence
  source: /note="Description of Artificial Sequence: Synthetic peptide"
WINTYTGESYFADDFKG

SEQ ID NO: 450 - protein, 17 aa, Artificial Sequence
  source: /note="Description of Artificial Sequence: Synthetic peptide"
WINTETREPAYAYDFRG

SEQ ID NO: 451 - protein, 17 aa, Artificial Sequence
  source: /note="Description of Artificial Sequence: Synthetic peptide"
RINTESGVPIYADDFKG

SEQ ID NO: 452 - protein, 17 aa, Artificial Sequence
  source: /note="Description of Artificial Sequence: Synthetic peptide"
RINTETGEPLYADDFKG

SEQ ID NO: 453 - protein, 7 aa, Artificial Sequence
  source: /note="Description of Artificial Sequence: Synthetic peptide"
HGGESDV

SEQ ID NO: 454 - protein, 11 aa, Artificial Sequence
  source: /note="Description of Artificial Sequence: Synthetic peptide"
SPAHYYGGMDV

SEQ ID NO: 455 - protein, 6 aa, Artificial Sequence
  source: /note="Description of Artificial Sequence: Synthetic peptide"
HSFLAY

SEQ ID NO: 456 - protein, 11 aa, Artificial Sequence
  source: /note="Description of Artificial Sequence: Synthetic peptide"
GPYYYQSYMDV

SEQ ID NO: 457 - protein, 14 aa, Artificial Sequence
  source: /note="Description of Artificial Sequence: Synthetic peptide"
LDSSGYYYARGPRY

SEQ ID NO: 458 - protein, 9 aa, Artificial Sequence
  source: /note="Description of Artificial Sequence: Synthetic peptide"
GPYYYYMDV

SEQ ID NO: 459 - protein, 8 aa, Artificial Sequence
  source: /note="Description of Artificial Sequence: Synthetic peptide"
ESGDGMDV

SEQ ID NO: 460 - protein, 8 aa, Artificial Sequence
  source: /note="Description of Artificial Sequence: Synthetic peptide"
STMVREDY

SEQ ID NO: 461 - protein, 11 aa, Artificial Sequence
  source: /note="Description of Artificial Sequence: Synthetic peptide"
HWQEWPDAFDI

SEQ ID NO: 462 - protein, 13 aa, Artificial Sequence
  source: /note="Description of Artificial Sequence: Synthetic peptide"
SGAGGTSATAFDI

SEQ ID NO: 463 - protein, 10 aa, Artificial Sequence
  source: /note="Description of Artificial Sequence: Synthetic peptide"
TIAAVYAFDI

SEQ ID NO: 464 - protein, 8 aa, Artificial Sequence
  source: /note="Description of Artificial Sequence: Synthetic peptide"
DLRGAFDI

SEQ ID NO: 465 - protein, 11 aa, Artificial Sequence
  source: /note="Description of Artificial Sequence: Synthetic peptide"
EGSGSGWYFDF

SEQ ID NO: 466 - protein, 13 aa, Artificial Sequence
  source: /note="Description of Artificial Sequence: Synthetic peptide"
AGIAARLRGAFDI

SEQ ID NO: 467 - protein, 20 aa, Artificial Sequence
  source: /note="Description of Artificial Sequence: Synthetic peptide"
RGGYQLLRWDVGLLRSAFDI

SEQ ID NO: 468 - protein, 13 aa, Artificial Sequence
  source: /note="Description of Artificial Sequence: Synthetic peptide"
SSPEGLFLYWFDP

SEQ ID NO: 469 - protein, 9 aa, Artificial Sequence
  source: /note="Description of Artificial Sequence: Synthetic peptide"
VEGSGSLDY

SEQ ID NO: 470 - protein, 9 aa, Artificial Sequence
  source: /note="Description of Artificial Sequence: Synthetic peptide"
RAGSEASDI

SEQ ID NO: 471 - protein, 15 aa, Artificial Sequence
  source: /note="Description of Artificial Sequence: Synthetic peptide"
ATYKRELRYYYGMDV

SEQ ID NO: 472 - protein, 8 aa, Artificial Sequence
  source: /note="Description of Artificial Sequence: Synthetic peptide"
VGKAVPDV

SEQ ID NO: 473 - protein, 13 aa, Artificial Sequence
  source: /note="Description of Artificial Sequence: Synthetic peptide"
HQGVAYYNYAMDV

SEQ ID NO: 474 - protein, 8 aa, Artificial Sequence
  source: /note="Description of Artificial Sequence: Synthetic peptide"
VVRDGMDV

SEQ ID NO: 475 - protein, 9 aa, Artificial Sequence
  source: /note="Description of Artificial Sequence: Synthetic peptide"
IPQTGTFDY

SEQ ID NO: 476 - protein, 15 aa, Artificial Sequence
  source: /note="Description of Artificial Sequence: Synthetic peptide"
ANYKRELRYYYGMDV

SEQ ID NO: 477 - protein, 11 aa, Artificial Sequence
  source: /note="Description of Artificial Sequence: Synthetic peptide"
ALVGATGAFDI

SEQ ID NO: 478 - protein, 8 aa, Artificial Sequence
  source: /note="Description of Artificial Sequence: Synthetic peptide"
WFGEGFDP

SEQ ID NO: 479 - protein, 17 aa, Artificial Sequence
  source: /note="Description of Artificial Sequence: Synthetic peptide"
VGYDSSGYYRDYYGMDV

SEQ ID NO: 480 - protein, 13 aa, Artificial Sequence
  source: /note="Description of Artificial Sequence: Synthetic peptide"
MGWSSGYLGAFDI

SEQ ID NO: 481 - protein, 13 aa, Artificial Sequence
  source: /note="Description of Artificial Sequence: Synthetic peptide"
GEIYYGYDGGFAY

SEQ ID NO: 482 - protein, 8 aa, Artificial Sequence
  source: /note="Description of Artificial Sequence: Synthetic peptide"
DYSYAMDY

SEQ ID NO: 483 - protein, 8 aa, Artificial Sequence
  source: /note="Description of Artificial Sequence: Synthetic peptide"
DYLYSLDF

SEQ ID NO: 484 - protein, 8 aa, Artificial Sequence
  source: /note="Description of Artificial Sequence: Synthetic peptide"
DYLYSCDY

SEQ ID NO: 485 - protein, 12 aa, Artificial Sequence
  source: /note="Description of Artificial Sequence: Synthetic peptide"
RASQSISSSFLA

SEQ ID NO: 486 - protein, 16 aa, Artificial Sequence
  source: /note="Description of Artificial Sequence: Synthetic peptide"
RSSQSLLHSNGYNYLD

SEQ ID NO: 487 - protein, 16 aa, Artificial Sequence
  source: /note="Description of Artificial Sequence: Synthetic peptide"
KSSQSLLRNDGKTPLY

SEQ ID NO: 488 - protein, 16 aa, Artificial Sequence
  source: /note="Description of Artificial Sequence: Synthetic peptide"
RSSQSLLHSNGYNYLN

SEQ ID NO: 489 - protein, 16 aa, Artificial Sequence
  source: /note="Description of Artificial Sequence: Synthetic peptide"
RSSQSLLYSNGYNYVD

SEQ ID NO: 490 - protein, 11 aa, Artificial Sequence
  source: /note="Description of Artificial Sequence: Synthetic peptide"
RASQSVSSNLA

SEQ ID NO: 491 - protein, 11 aa, Artificial Sequence
  source: /note="Description of Artificial Sequence: Synthetic peptide"
RASQSVSSKLA

SEQ ID NO: 492 - protein, 12 aa, Artificial Sequence
  source: /note="Description of Artificial Sequence: Synthetic peptide"
RASQSVGSTNLA

SEQ ID NO: 493 - protein, 16 aa, Artificial Sequence
  source: /note="Description of Artificial Sequence: Synthetic peptide"
KSSESLVHNSGKTYLN

SEQ ID NO: 494 - protein, 11 aa, Artificial Sequence
  source: /note="Description of Artificial Sequence: Synthetic peptide"
QASEDINKFLN

SEQ ID NO: 495 - protein, 11 aa, Artificial Sequence
  source: /note="Description of Artificial Sequence: Synthetic peptide"
RASQSVGSNLA

SEQ ID NO: 496 - protein, 12 aa, Artificial Sequence
  source: /note="Description of Artificial Sequence: Synthetic peptide"
RASQSIGSSSLA

SEQ ID NO: 497 - protein, 11 aa, Artificial Sequence
  source: /note="Description of Artificial Sequence: Synthetic peptide"
KASQDIDDAMN

SEQ ID NO: 498 - protein, 11 aa, Artificial Sequence
  source: /note="Description of Artificial Sequence: Synthetic peptide"
RASQDIYNNLA

SEQ ID NO: 499 - protein, 11 aa, Artificial Sequence
  source: /note="Description of Artificial Sequence: Synthetic peptide"
GGNNIGTKSVH

SEQ ID NO: 500 - protein, 11 aa, Artificial Sequence
  source: /note="Description of Artificial Sequence: Synthetic peptide"
SGDGLSKKYVS

SEQ ID NO: 501 - protein, 11 aa, Artificial Sequence
  source: /note="Description of Artificial Sequence: Synthetic peptide"
RASQGIRNWLA

SEQ ID NO: 502 - protein, 11 aa, Artificial Sequence
  source: /note="Description of Artificial Sequence: Synthetic peptide"
GGNNIGSKSVH

SEQ ID NO: 503 - protein, 11 aa, Artificial Sequence
  source: /note="Description of Artificial Sequence: Synthetic peptide"
QGDSLGNYYAT

SEQ ID NO: 504 - protein, 12 aa, Artificial Sequence
  source: /note="Description of Artificial Sequence: Synthetic peptide"
RASQSVSSAYLA

SEQ ID NO: 505 - protein, 11 aa, Artificial Sequence
  source: /note="Description of Artificial Sequence: Synthetic peptide"
RASQSVSNSLA

SEQ ID NO: 506 - protein, 12 aa, Artificial Sequence
  source: /note="Description of Artificial Sequence: Synthetic peptide"
RASQSVSSSFLA

SEQ ID NO: 507 - protein, 12 aa, Artificial Sequence
  source: /note="Description of Artificial Sequence: Synthetic peptide"
RASQSVSTTFLA

SEQ ID NO: 508 - protein, 12 aa, Artificial Sequence
  source: /note="Description of Artificial Sequence: Synthetic peptide"
RATQSIGSSFLA

SEQ ID NO: 509 - protein, 12 aa, Artificial Sequence
  source: /note="Description of Artificial Sequence: Synthetic peptide"
RASQSVSSSYLA

SEQ ID NO: 510 - protein, 12 aa, Artificial Sequence
  source: /note="Description of Artificial Sequence: Synthetic peptide"
RASQRVASNYLA

SEQ ID NO: 511 - protein, 12 aa, Artificial Sequence
  source: /note="Description of Artificial Sequence: Synthetic peptide"
RASQSLSSNFLA

SEQ ID NO: 512 - protein, 12 aa, Artificial Sequence
  source: /note="Description of Artificial Sequence: Synthetic peptide"
RASQSVASSFLA

SEQ ID NO: 513 - protein, 11 aa, Artificial Sequence
  source: /note="Description of Artificial Sequence: Synthetic peptide"
RASQDVNTAVS

SEQ ID NO: 514 - protein, 15 aa, Artificial Sequence
  source: /note="Description of Artificial Sequence: Synthetic peptide"
RASESVSVIGAHLIH

SEQ ID NO: 515 - protein, 15 aa, Artificial Sequence
  source: /note="Description of Artificial Sequence: Synthetic peptide"
RASESVTILGSHLIY

SEQ ID NO: 516 - protein, 7 aa, Artificial Sequence
  source: /note="Description of Artificial Sequence: Synthetic peptide"
GASRRAT

SEQ ID NO: 517 - protein, 7 aa, Artificial Sequence
  source: /note="Description of Artificial Sequence: Synthetic peptide"
LGSNRAS

SEQ ID NO: 518 - protein, 7 aa, Artificial Sequence
  source: /note="Description of Artificial Sequence: Synthetic peptide"
EVSNRFS

SEQ ID NO: 519 - protein, 7 aa, Artificial Sequence
  source: /note="Description of Artificial Sequence: Synthetic peptide"
LGSKRAS

SEQ ID NO: 520 - protein, 7 aa, Artificial Sequence
  source: /note="Description of Artificial Sequence: Synthetic peptide"
GASTLAS

SEQ ID NO: 521 - protein, 7 aa, Artificial Sequence
  source: /note="Description of Artificial Sequence: Synthetic peptide"
GASTRAS

SEQ ID NO: 522 - protein, 7 aa, Artificial Sequence
  source: /note="Description of Artificial Sequence: Synthetic peptide"
GASIRAT

SEQ ID NO: 523 - protein, 7 aa, Artificial Sequence
  source: /note="Description of Artificial Sequence: Synthetic peptide"
DASNRAT

SEQ ID NO: 524 - protein, 7 aa, Artificial Sequence
  source: /note="Description of Artificial Sequence: Synthetic peptide"
EVSNRDS

SEQ ID NO: 525 - protein, 7 aa, Artificial Sequence
  source: /note="Description of Artificial Sequence: Synthetic peptide"
DASTLQT

SEQ ID NO: 526 - protein, 7 aa, Artificial Sequence
  source: /note="Description of Artificial Sequence: Synthetic peptide"
GASTRAT

SEQ ID NO: 527 - protein, 7 aa, Artificial Sequence
  source: /note="Description of Artificial Sequence: Synthetic peptide"
GASSRAS

SEQ ID NO: 528 - protein, 7 aa, Artificial Sequence
  source: /note="Description of Artificial Sequence: Synthetic peptide"
SATSPVP

SEQ ID NO: 529 - protein, 7 aa, Artificial Sequence
  source: /note="Description of Artificial Sequence: Synthetic peptide"
AANKSQS

SEQ ID NO: 530 - protein, 7 aa, Artificial Sequence
  source: /note="Description of Artificial Sequence: Synthetic peptide"
DDSVRPS

SEQ ID NO: 531 - protein, 7 aa, Artificial Sequence
  source: /note="Description of Artificial Sequence: Synthetic peptide"
RDKERPS

SEQ ID NO: 532 - protein, 7 aa, Artificial Sequence
  source: /note="Description of Artificial Sequence: Synthetic peptide"
AASNLQS

SEQ ID NO: 533 - protein, 7 aa, Artificial Sequence
  source: /note="Description of Artificial Sequence: Synthetic peptide"
GKNNRPS

SEQ ID NO: 534 - protein, 7 aa, Artificial Sequence
  source: /note="Description of Artificial Sequence: Synthetic peptide"
GTNNRPS

SEQ ID NO: 535 - protein, 7 aa, Artificial Sequence
  source: /note="Description of Artificial Sequence: Synthetic peptide"
DASSRAT

SEQ ID NO: 536 - protein, 7 aa, Artificial Sequence
  source: /note="Description of Artificial Sequence: Synthetic peptide"
GASSRAT

SEQ ID NO: 537 - protein, 7 aa, Artificial Sequence
  source: /note="Description of Artificial Sequence: Synthetic peptide"
GSSNRAT

SEQ ID NO: 538 - protein, 7 aa, Artificial Sequence
  source: /note="Description of Artificial Sequence: Synthetic peptide"
GASQRAT

SEQ ID NO: 539 - protein, 7 aa, Artificial Sequence
  source: /note="Description of Artificial Sequence: Synthetic peptide"
GASNWAT

SEQ ID NO: 540 - protein, 7 aa, Artificial Sequence
  source: /note="Description of Artificial Sequence: Synthetic peptide"
GTSSRAT

SEQ ID NO: 541 - protein, 7 aa, Artificial Sequence
  source: /note="Description of Artificial Sequence: Synthetic peptide"
GASGRAT

SEQ ID NO: 542 - protein, 7 aa, Artificial Sequence
  source: /note="Description of Artificial Sequence: Synthetic peptide"
SASYRYT

SEQ ID NO: 543 - protein, 7 aa, Artificial Sequence
  source: /note="Description of Artificial Sequence: Synthetic peptide"
LASNLET

SEQ ID NO: 544 - protein, 7 aa, Artificial Sequence
  source: /note="Description of Artificial Sequence: Synthetic peptide"
LASNVQT

SEQ ID NO: 545 - protein, 9 aa, Artificial Sequence
  source: /note="Description of Artificial Sequence: Synthetic peptide"
QQSYSTPYT

SEQ ID NO: 546 - protein, 10 aa, Artificial Sequence
  source: /note="Description of Artificial Sequence: Synthetic peptide"
QQYHSSPSWT

SEQ ID NO: 547 - protein, 9 aa, Artificial Sequence
  source: /note="Description of Artificial Sequence: Synthetic peptide"
MQALQTPYT

SEQ ID NO: 548 - protein, 8 aa, Artificial Sequence
  source: /note="Description of Artificial Sequence: Synthetic peptide"
MQNIQFPS

SEQ ID NO: 549 - protein, 8 aa, Artificial Sequence
  source: /note="Description of Artificial Sequence: Synthetic peptide"
QQSYKRAS

SEQ ID NO: 550 - protein, 9 aa, Artificial Sequence
  source: /note="Description of Artificial Sequence: Synthetic peptide"
MQGRQFPYS

SEQ ID NO: 551 - protein, 8 aa, Artificial Sequence
  source: /note="Description of Artificial Sequence: Synthetic peptide"
QQYGSSLT

SEQ ID NO: 552 - protein, 9 aa, Artificial Sequence
  source: /note="Description of Artificial Sequence: Synthetic peptide"
QQYGSSSWT

SEQ ID NO: 553 - protein, 10 aa, Artificial Sequence
  source: /note="Description of Artificial Sequence: Synthetic peptide"
QQYGSSPPWT

SEQ ID NO: 554 - protein, 7 aa, Artificial Sequence
  source: /note="Description of Artificial Sequence: Synthetic peptide"
QQSYTLA

SEQ ID NO: 555 - protein, 9 aa, Artificial Sequence
  source: /note="Description of Artificial Sequence: Synthetic peptide"
MQGTHWPGT

SEQ ID NO: 556 - protein, 9 aa, Artificial Sequence
  source: /note="Description of Artificial Sequence: Synthetic peptide"
QQYESLPLT

SEQ ID NO: 557 - protein, 10 aa, Artificial Sequence
  source: /note="Description of Artificial Sequence: Synthetic peptide"
QQYNDWLPVT

SEQ ID NO: 558 - protein, 10 aa, Artificial Sequence
  source: /note="Description of Artificial Sequence: Synthetic peptide"
QQYAGSPPFT

SEQ ID NO: 559 - protein, 9 aa, Artificial Sequence
  source: /note="Description of Artificial Sequence: Synthetic peptide"
LQHDNFPLT

SEQ ID NO: 560 - protein, 9 aa, Artificial Sequence
  source: /note="Description of Artificial Sequence: Synthetic peptide"
QHYYRFPYS

SEQ ID NO: 561 - protein, 11 aa, Artificial Sequence
  source: /note="Description of Artificial Sequence: Synthetic peptide"
QVWDSDSEHVV

SEQ ID NO: 562 - protein, 9 aa, Artificial Sequence
  source: /note="Description of Artificial Sequence: Synthetic peptide"
QAWDDTTVV

SEQ ID NO: 563 - protein, 9 aa, Artificial Sequence
  source: /note="Description of Artificial Sequence: Synthetic peptide"
QKYNSAPFT

SEQ ID NO: 564 - protein, 12 aa, Artificial Sequence
  source: /note="Description of Artificial Sequence: Synthetic peptide"
SSRDSSGDHLRV

SEQ ID NO: 565 - protein, 11 aa, Artificial Sequence
  source: /note="Description of Artificial Sequence: Synthetic peptide"
NSRDSSGHHLL

SEQ ID NO: 566 - protein, 14 aa, Artificial Sequence
  source: /note="Description of Artificial Sequence: Synthetic peptide"
QHYGSSFNGSSLFT

SEQ ID NO: 567 - protein, 10 aa, Artificial Sequence
  source: /note="Description of Artificial Sequence: Synthetic peptide"
QQFGTSSGLT

SEQ ID NO: 568 - protein, 9 aa, Artificial Sequence
  source: /note="Description of Artificial Sequence: Synthetic peptide"
QQSYSTPYS

SEQ ID NO: 569 - protein, 10 aa, Artificial Sequence
  source: /note="Description of Artificial Sequence: Synthetic peptide"
QHYESSPSWT

SEQ ID NO: 570 - protein, 10 aa, Artificial Sequence
  source: /note="Description of Artificial Sequence: Synthetic peptide"
QQYGSPPRFT

SEQ ID NO: 571 - protein, 10 aa, Artificial Sequence
  source: /note="Description of Artificial Sequence: Synthetic peptide"
QHYGSSPSWT

SEQ ID NO: 572 - protein, 10 aa, Artificial Sequence
  source: /note="Description of Artificial Sequence: Synthetic peptide"
QHYDSSPSWT

SEQ ID NO: 573 - protein, 10 aa, Artificial Sequence
  source: /note="Description of Artificial Sequence: Synthetic peptide"
QYYGTSPMYT

SEQ ID NO: 574 - protein, 9 aa, Artificial Sequence
  source: /note="Description of Artificial Sequence: Synthetic peptide"
MQALQTPLT

SEQ ID NO: 575 - protein, 11 aa, Artificial Sequence
  source: /note="Description of Artificial Sequence: Synthetic peptide"
QHYGNSPPKFT

SEQ ID NO: 576 - protein, 10 aa, Artificial Sequence
  source: /note="Description of Artificial Sequence: Synthetic peptide"
QHYGGSPRLT

SEQ ID NO: 577 - protein, 9 aa, Artificial Sequence
  source: /note="Description of Artificial Sequence: Synthetic peptide"
QQHYSTPWT

SEQ ID NO: 578 - protein, 9 aa, Artificial Sequence
  source: /note="Description of Artificial Sequence: Synthetic peptide"
LQSRIFPRT

SEQ ID NO: 579 - protein, 9 aa, Artificial Sequence
  source: /note="Description of Artificial Sequence: Synthetic peptide"
LQSRTIPRT

SEQ ID NO: 580 - protein, 239 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 581 - DNA, 717 bp, Artificial Sequence
  source: /note="Description of Artificial Sequence: Synthetic polynucleotide"
gaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaag

SEQ ID NO: 582 - protein, 115 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 583 - protein, 107 aa, Artificial Sequence
  source: /note="Description of Artificial Sequence: Synthetic polypeptide"
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIK

SEQ ID NO: 584 - protein, 483 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 585 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcgcgtccggcggaggcggcagcgggggtcgggcatcagggggcggcggatcggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 586 - protein, 246 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 587 - DNA, 738 bp, Artificial Sequence
  source: /note="Description of Artificial Sequence: Synthetic polynucleotide"
caagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaag

SEQ ID NO: 588 - protein, 120 aa, Artificial Sequence
  source: /note="Description of Artificial Sequence: Synthetic polypeptide"
QVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSS

SEQ ID NO: 589 - protein, 109 aa, Artificial Sequence
  source: /note="Description of Artificial Sequence: Synthetic polypeptide"
DIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIK

SEQ ID NO: 590 - protein, 490 aa, Artificial Sequence
  source: /note="Description of Artificial Sequence: Synthetic polypeptide"
MALPVTALLLPLALLLHAARPQVQLVESGGGLVQPGRSLRLSCAASGFTFSNYAMSWVRQAPGKGLGWVSGISRSGENTYYADSVKGRFTISRDNSKNTLYLQMNSLRDEDTAVYYCARSPAHYYGGMDVWGQGTTVTVSSASGGGGSGGRASGGGGSDIVLTQSPGTLSLSPGERATLSCRASQSISSSFLAWYQQKPGQAPRLLIYGASRRATGIPDRFSGSGSGTDFTLTISRLEPEDSAVYYCQQYHSSPSWTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 591 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggaagatcgcttagactgtcgtgtgccgccagcgggttcactttctcgaactacgcgatgtcctgggtccgccaggcacccggaaagggactcggttgggtgtccggcatttcccggtccggcgaaaatacctactacgccgactccgtgaagggccgcttcaccatctcaagggacaacagcaaaaacaccctgtacttgcaaatgaactccctgcgggatgaagatacagccgtgtactattgcgcccggtcgcctgcccattactacggcggaatggacgtctggggacagggaaccactgtgactgtcagcagcgcgtcgggtggcggcggctcagggggtcgggcctccggggggggagggtccgacatcgtgctgacccagtccccgggaaccctgagcctgagcccgggagagcgcgcgaccctgtcatgccgggcatcccagagcattagctcctcctttctcgcctggtatcagcagaagcccggacaggccccgaggctgctgatctacggcgctagcagaagggctaccggaatcccagaccggttctccggctccggttccgggaccgatttcacccttactatctcgcgcctggaacctgaggactccgccgtctactactgccagcagtaccactcatccccgtcgtggacgttcggacagggcaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 592 - protein, 244 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 593 - DNA, 732 bp, Artificial Sequence
  source: /note="Description of Artificial Sequence: Synthetic polynucleotide"
caagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaag

SEQ ID NO: 594 - protein, 115 aa, Artificial Sequence
  source: /note="Description of Artificial Sequence: Synthetic polypeptide"
QVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSS

SEQ ID NO: 595 - protein, 112 aa, Artificial Sequence
  source: /note="Description of Artificial Sequence: Synthetic polypeptide"
DIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIK

SEQ ID NO: 596 - protein, 488 aa, Artificial Sequence
  source: /note="Description of Artificial Sequence: Synthetic polypeptide"
MALPVTALLLPLALLLHAARPQVQLVESGGGLVQPGRSLRLSCAASGFTFDDYAMHWVRQAPGKGLEWVSGISWNSGSIGYADSVKGRFTISRDNAKNSLYLQMNSLRAEDTALYYCSVHSFLAYWGQGTLVTVSSASGGGGSGGRASGGGGSDIVMTQTPLSLPVTPGEPASISCRSSQSLLHSNGYNYLDWYLQKPGQSPQLLIYLGSNRASGVPDRFSGSGSGTDFTLKISRVEAEDVGVYYCMQALQTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 597 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtcgaatccggtggaggtctggtccaacctggtagaagcctgagactgtcgtgtgcggccagcggattcacctttgatgactatgctatgcactgggtgcggcaggccccaggaaagggcctggaatgggtgtcgggaattagctggaactccgggtccattggctacgccgactccgtgaagggccgcttcaccatctcccgcgacaacgcaaagaactccctgtacttgcaaatgaactcgctcagggctgaggataccgcgctgtactactgctccgtgcattccttcctggcctactggggacagggaactctggtcaccgtgtcgagcgcctccggcggcgggggctcgggtggacgggcctcgggcggaggggggtccgacatcgtgatgacccagaccccgctgagcttgcccgtgactcccggagagcctgcatccatctcctgccggtcatcccagtcccttctccactccaacggatacaactacctcgactggtacctccagaagccgggacagagccctcagcttctgatctacctggggtcaaatagagcctcaggagtgccggatcggttcagcggatctggttcgggaactgatttcactctgaagatttcccgcgtggaagccgaggacgtgggcgtctactactgtatgcaggcgctgcagaccccctataccttcggccaagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 598 - protein, 243 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 599 - DNA, 729 bp, Artificial Sequence
  source: /note="Description of Artificial Sequence: Synthetic polynucleotide"
gaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaag

SEQ ID NO: 600 - protein, 115 aa, Artificial Sequence
  source: /note="Description of Artificial Sequence: Synthetic polypeptide"
EVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 601 - protein, 111 aa, Artificial Sequence
  source: /note="Description of Artificial Sequence: Synthetic polypeptide"
DIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIK

SEQ ID NO: 602 - protein, 487 aa, Artificial Sequence
  source: /note="Description of Artificial Sequence: Synthetic polypeptide"
MALPVTALLLPLALLLHAARPEVQLLESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIVMTQTPLSLSVTPGQPASISCKSSQSLLRNDGKTPLYWYLQKAGQPPQLLIYEVSNRFSGVPDRFSGSGSGTDFTLKISRVEAEDVGAYYCMQNIQFPSFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 603 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgttggaatctggaggaggacttgtgcagcctggaggatcactgagactttcgtgtgcggtgtcaggcttcgccctgagcaaccacggcatgagctgggtgcggagagccccggggaagggtctggaatgggtgtccgggatcgtctactccggttcaacttactacgccgcaagcgtgaagggtcgcttcaccatttcccgcgataactcccggaacaccctgtacctccaaatgaactccctgcggcccgaggacaccgccatctactactgttccgcgcatggaggagagtccgatgtctggggacagggcactaccgtgaccgtgtcgagcgcctcggggggaggaggctccggcggtcgcgcctccggggggggtggcagcgacattgtgatgacgcagactccactctcgctgtccgtgaccccgggacagcccgcgtccatctcgtgcaagagctcccagagcctgctgaggaacgacggaaagactcctctgtattggtacctccagaaggctggacagcccccgcaactgctcatctacgaagtgtcaaatcgcttctccggggtgccggatcggttttccggctcgggatcgggcaccgacttcaccctgaaaatctccagggtcgaggccgaggacgtgggagcctactactgcatgcaaaacatccagttcccttccttcggcggcggcacaaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 604 - protein, 249 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 605 - DNA, 747 bp, Artificial Sequence
  source: /note="Description of Artificial Sequence: Synthetic polynucleotide"
caagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaag

SEQ ID NO: 606 - protein, 120 aa, Artificial Sequence
  source: /note="Description of Artificial Sequence: Synthetic polypeptide"
QVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSS

SEQ ID NO: 607 - protein, 112 aa, Artificial Sequence
  source: /note="Description of Artificial Sequence: Synthetic polypeptide"
DIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIK

SEQ ID NO: 608 - protein, 493 aa, Artificial Sequence
  source: /note="Description of Artificial Sequence: Synthetic polypeptide"
MALPVTALLLPLALLLHAARPQVQLVQSGAEVRKTGASVKVSCKASGYIFDNFGINWVRQAPGQGLEWMGWINPKNNNTNYAQKFQGRVTITADESTNTAYMEVSSLRSEDTAVYYCARGPYYYQSYMDVWGQGTMVTVSSASGGGGSGGRASGGGGSDIVMTQTPLSLPVTPGEPASISCRSSQSLLHSNGYNYLNWYLQKPGQSPQLLIYLGSKRASGVPDRFSGSGSGTDFTLHITRVGAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 609 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggcgcagaagtcagaaaaaccggtgctagcgtgaaagtgtcctgcaaggcctccggctacattttcgataacttcggaatcaactgggtcagacaggccccgggccaggggctggaatggatgggatggatcaaccccaagaacaacaacaccaactacgcacagaagttccagggccgcgtgactatcaccgccgatgaatcgaccaataccgcctacatggaggtgtcctccctgcggtcggaggacactgccgtgtattactgcgcgaggggcccatactactaccaaagctacatggacgtctggggacagggaaccatggtgaccgtgtcatccgcctccggtggtggaggctccggggggcgggcttcaggaggcggaggaagcgatattgtgatgacccagactccgcttagcctgcccgtgactcctggagaaccggcctccatttcctgccggtcctcgcaatcactcctgcattccaacggttacaactacctgaattggtacctccagaagcctggccagtcgccccagttgctgatctatctgggctcgaagcgcgcctccggggtgcctgaccggtttagcggatctgggagcggcacggacttcactctccacatcacccgcgtgggagcggaggacgtgggagtgtactactgtatgcaggcgctgcagactccgtacacattcggacagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 610 - protein, 246 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 611 - DNA, 738 bp, Artificial Sequence
  source: /note="Description of Artificial Sequence: Synthetic polynucleotide"
caagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaag

SEQ ID NO: 612 - protein, 123 aa, Artificial Sequence
  source: /note="Description of Artificial Sequence: Synthetic polypeptide"
QVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSS

SEQ ID NO: 613 - protein, 106 aa, Artificial Sequence
  source: /note="Description of Artificial Sequence: Synthetic polypeptide"
DIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIK

SEQ ID NO: 614 - protein, 490 aa, Artificial Sequence
  source: /note="Description of Artificial Sequence: Synthetic polypeptide"
MALPVTALLLPLALLLHAARPQVQLQESGGGLVQPGGSLRLSCAASGFTFSSDAMTWVRQAPGKGLEWVSVISGSGGTTYYADSVKGRFTISRDNSKNTLYLQMNSLRAEDTAVYYCAKLDSSGYYYARGPRYWGQGTLVTVSSASGGGGSGGRASGGGGSDIQLTQSPSSLSASVGDRVTITCRASQSISSYLNWYQQKPGKAPKLLIYGASTLASGVPARFSGSGSGTHFTLTINSLQSEDSATYYCQQSYKRASFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 615 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaacttcaagaatcaggcggaggactcgtgcagcccggaggatcattgcggctctcgtgcgccgcctcgggcttcaccttctcgagcgacgccatgacctgggtccgccaggccccggggaaggggctggaatgggtgtctgtgatttccggctccgggggaactacgtactacgccgattccgtgaaaggtcgcttcactatctcccgggacaacagcaagaacaccctttatctgcaaatgaattccctccgcgccgaggacaccgccgtgtactactgcgccaagctggactcctcgggctactactatgcccggggtccgagatactggggacagggaaccctcgtgaccgtgtcctccgcgtccggcggaggagggtcgggagggcgggcctccggcggcggcggttcggacatccagctgacccagtccccatcctcactgagcgcaagcgtgggcgacagagtcaccattacatgcagggcgtcccagagcatcagctcctacctgaactggtaccaacagaagcctggaaaggctcctaagctgttgatctacggggcttcgaccctggcatccggggtgcccgcgaggtttagcggaagcggtagcggcactcacttcactctgaccattaacagcctccagtccgaggattcagccacttactactgtcagcagtcctacaagcgggccagcttcggacagggcactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 616 - protein, 247 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 617 - DNA, 741 bp, Artificial Sequence
  source: /note="Description of Artificial Sequence: Synthetic polynucleotide"
caagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaag

SEQ ID NO: 618 - protein, 118 aa, Artificial Sequence
  source: /note="Description of Artificial Sequence: Synthetic polypeptide"
QVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSS

SEQ ID NO: 619 - protein, 112 aa, Artificial Sequence
  source: /note="Description of Artificial Sequence: Synthetic polypeptide"
EIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIK

SEQ ID NO: 620 - protein, 491 aa, Artificial Sequence
  source: /note="Description of Artificial Sequence: Synthetic polypeptide"
MALPVTALLLPLALLLHAARPQVQLVQSGAEVKKPGASVKVSCKASGYTFSNYGITWVRQAPGQGLEWMGWISAYNGNTNYAQKFQGRVTMTRNTSISTAYMELSSLRSEDTAVYYCARGPYYYYMDVWGKGTMVTVSSASGGGGSGGRASGGGGSEIVMTQSPLSLPVTPGEPASISCRSSQSLLYSNGYNYVDWYLQKPGQSPQLLIYLGSNRASGVPDRFSGSGSGTDFKLQISRVEAEDVGIYYCMQGRQFPYSFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 621 - DNA, 1473 bp, Artificial Sequence
  source: /note="Description of Artificial Sequence: Synthetic polynucleotide"
atggccctccctgtcaccgccctgctgcttccgctggctcttctgctccacgccgctcggccccaagtccaactggtccagagcggtgcagaagtgaagaagcccggagcgagcgtgaaagtgtcctgcaaggcttccgggtacaccttctccaactacggcatcacttgggtgcgccaggccccgggacagggcctggaatggatggggtggatttccgcgtacaacggcaatacgaactacgctcagaagttccagggtagagtgaccatgactaggaacacctccatttccaccgcctacatggaactgtcctccctgcggagcgaggacaccgccgtgtactattgcgcccggggaccatactactactacatggatgtctgggggaaggggactatggtcaccgtgtcatccgcctcgggaggcggcggatcaggaggacgcgcctctggtggtggaggatcggagatcgtgatgacccagagccctctctccttgcccgtgactcctggggagcccgcatccatttcatgccggagctcccagtcacttctctactccaacggctataactacgtggattggtacctccaaaagccgggccagagcccgcagctgctgatctacctgggctcgaacagggccagcggagtgcctgaccggttctccgggtcgggaagcgggaccgacttcaagctgcaaatctcgagagtggaggccgaggacgtgggaatctactactgtatgcagggccgccagtttccgtactcgttcggacagggcaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 622 - protein, 238 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 623 - DNA, 714 bp, Artificial Sequence
  source: /note="Description of Artificial Sequence: Synthetic polynucleotide"
gaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaag

SEQ ID NO: 624 - protein, 115 aa, Artificial Sequence
  source: /note="Description of Artificial Sequence: Synthetic polypeptide"
EVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 625 - protein, 106 aa, Artificial Sequence
  source: /note="Description of Artificial Sequence: Synthetic polypeptide"
EIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIK

SEQ ID NO: 626 - protein, 482 aa, Artificial Sequence
  source: /note="Description of Artificial Sequence: Synthetic polypeptide"
MALPVTALLLPLALLLHAARPEVQLLETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPATLSVSPGESATLSCRASQSVSSNLAWYQQKPGQAPRLLIYGASTRASGIPDRFSGSGSGTDFTLTISSLQAEDVAVYYCQQYGSSLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 627 - DNA, 1446 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattgctcgaaactggaggaggtctggtgcaacctggaggatcacttcgcctgtcctgcgccgtgtcgggctttgccctgtccaaccatggaatgagctgggtccgccgcgcgccggggaagggcctcgaatgggtgtccggcatcgtctactccggctccacctactacgccgcgtccgtgaagggccggttcacgatttcacgggacaactcgcggaacaccctgtacctccaaatgaattcccttcggccggaggatactgccatctactactgctccgcccacggtggcgaatccgacgtctggggccagggaaccaccgtgaccgtgtccagcgcgtccgggggaggaggaagcgggggtagagcatcgggtggaggcggatcagagatcgtgctgacccagtcccccgccaccttgagcgtgtcaccaggagagtccgccaccctgtcatgccgcgccagccagtccgtgtcctccaacctggcttggtaccagcagaagccggggcaggcccctagactcctgatctatggggcgtcgacccgggcatctggaattcccgataggttcagcggatcgggctcgggcactgacttcactctgaccatctcctcgctgcaagccgaggacgtggctgtgtactactgtcagcagtacggaagctccctgactttcggtggcgggaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 628 - protein, 239 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 629 - DNA, 717 bp, Artificial Sequence
  source: /note="Description of Artificial Sequence: Synthetic polynucleotide"
gaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaag

SEQ ID NO: 630 - protein, 115 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 631 - protein, 107 aa, Artificial Sequence
  source: /note="Description of Artificial Sequence: Synthetic polypeptide"
EIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIK

SEQ ID NO: 632 - protein, 483 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVMTQSPATLSVSPGERATLSCRASQSVSSKLAWYQQKPGQAPRLLMYGASIRATGIPDRFSGSGSGTEFTLTISSLEPEDFAVYYCQQYGSSSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 633 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgagactgagctgcgcagtgtcgggattcgccctgagcaaccatggaatgtcctgggtcagaagggcccctggaaaaggcctcgaatgggtgtcagggatcgtgtactccggttccacttactacgccgcctccgtgaaggggcgcttcactatctcacgggataactcccgcaataccctgtacctccaaatgaacagcctgcggccggaggataccgccatctactactgttccgcccacggtggagagtctgacgtctggggccagggaactaccgtgaccgtgtcctccgcgtccggcggtggagggagcggcggccgcgccagcggcggcggaggctccgagatcgtgatgacccagagccccgctactctgtcggtgtcgcccggagaaagggcgaccctgtcctgccgggcgtcgcagtccgtgagcagcaagctggcttggtaccagcagaagccgggccaggcaccacgcctgcttatgtacggtgcctccattcgggccaccggaatcccggaccggttctcggggtcggggtccggtaccgagttcacactgaccatttcctcgctcgagcccgaggactttgccgtctattactgccagcagtacggctcctcctcatggacgttcggccaggggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 634 - protein, 241 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 635 - DNA, 723 bp, Artificial Sequence
  source: /note="Description of Artificial Sequence: Synthetic polynucleotide"
gaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaag

SEQ ID NO: 636 - protein, 115 aa, Artificial Sequence
  source: /note="Description of Artificial Sequence: Synthetic polypeptide"
EVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 637 - protein, 109 aa, Artificial Sequence
  source: /note="Description of Artificial Sequence: Synthetic polypeptide"
EIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIK

SEQ ID NO: 638 - protein, 485 aa, Artificial Sequence
  source: /note="Description of Artificial Sequence: Synthetic polypeptide"
MALPVTALLLPLALLLHAARPEVQLVETGGGVVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSVGSTNLAWYQQKPGQAPRLLIYDASNRATGIPDRFSGGGSGTDFTLTISRLEPEDFAVYYCQQYGSSPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 639 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggagactggaggaggagtggtgcaacctggaggaagcctgagactgtcatgcgcggtgtcgggcttcgccctctccaaccacggaatgtcctgggtccgccgggcccctgggaaaggacttgaatgggtgtccggcatcgtgtactcgggttccacctactacgcggcctcagtgaagggccggtttactattagccgcgacaactccagaaacacactgtacctccaaatgaactcgctgcggccggaagataccgctatctactactgctccgcccatgggggagagtcggacgtctggggacagggcaccactgtcactgtgtccagcgcttccggcggtggtggaagcgggggacgggcctcaggaggcggtggcagcgagattgtgctgacccagtcccccgggaccctgagcctgtccccgggagaaagggccaccctctcctgtcgggcatcccagtccgtggggtctactaaccttgcatggtaccagcagaagcccggccaggcccctcgcctgctgatctacgacgcgtccaatagagccaccggcatcccggatcgcttcagcggaggcggatcgggcaccgacttcaccctcaccatttcaaggctggaaccggaggacttcgccgtgtactactgccagcagtatggttcgtccccaccctggacgttcggccaggggactaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 640 - protein, 239 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 641 - DNA, 717 bp, Artificial Sequence
  source: /note="Description of Artificial Sequence: Synthetic polynucleotide"
caagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaag

SEQ ID NO: 642 - protein, 117 aa, Artificial Sequence
  source: /note="Description of Artificial Sequence: Synthetic polypeptide"
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSS

SEQ ID NO: 643 - protein, 105 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIK

SEQ ID NO: 644 - protein, 483 aa, Artificial Sequence
  source: /note="Description of Artificial Sequence: Synthetic polypeptide"
MALPVTALLLPLALLLHAARPQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARESGDGMDVWGQGTTVTVSSASGGGGSGGRASGGGGSDIQMTQSPSSLSASVGDRVTITCRASQSISSYLNWYQQKPGKAPKLLIYAASSLQSGVPSRFSGSGSGTDFTLTISSLQPEDFATYYCQQSYTLAFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 645 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgaaacctggaggatcattgagactgtcatgcgcggcctcgggattcacgttctccgattactacatgagctggattcgccaggctccggggaagggactggaatgggtgtcctacatttcctcatccggctccaccatctactacgcggactccgtgaaggggagattcaccattagccgcgataacgccaagaacagcctgtaccttcagatgaactccctgcgggctgaagatactgccgtctactactgcgcaagggagagcggagatgggatggacgtctggggacagggtaccactgtgaccgtgtcgtcggcctccggcggagggggttcgggtggaagggccagcggcggcggaggcagcgacatccagatgacccagtccccctcatcgctgtccgcctccgtgggcgaccgcgtcaccatcacatgccgggcctcacagtcgatctcctcctacctcaattggtatcagcagaagcccggaaaggcccctaagcttctgatctacgcagcgtcctccctgcaatccggggtcccatctcggttctccggctcgggcagcggtaccgacttcactctgaccatctcgagcctgcagccggaggacttcgccacttactactgtcagcaaagctacaccctcgcgtttggccagggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 646 - protein, 246 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 647 - DNA, 738 bp, Artificial Sequence
  source: /note="Description of Artificial Sequence: Synthetic polynucleotide"
caagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaag

SEQ ID NO: 648 - protein, 117 aa, Artificial Sequence
  source: /note="Description of Artificial Sequence: Synthetic polypeptide"
QVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSS

SEQ ID NO: 649 - protein, 112 aa, Artificial Sequence
  source: /note="Description of Artificial Sequence: Synthetic polypeptide"
DIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIK

SEQ ID NO: 650 - protein, 490 aa, Artificial Sequence
  source: /note="Description of Artificial Sequence: Synthetic polypeptide"
MALPVTALLLPLALLLHAARPQVQLVQSGGGLVKPGGSLRLSCAASGFTFSDYYMSWIRQAPGKGLEWVSYISSSGNTIYYADSVKGRFTISRDNAKNSLYLQMNSLRAEDTAVYYCARSTMVREDYWGQGTLVTVSSASGGGGSGGRASGGGGSDIVLTQSPLSLPVTLGQPASISCKSSESLVHNSGKTYLNWFHQRPGQSPRRLIYEVSNRDSGVPDRFTGSGSGTDFTLKISRVEAEDVGVYYCMQGTHWPGTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 651 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactggtgcaaagcggaggaggattggtcaaacccggaggaagcctgagactgtcatgcgcggcctctggattcaccttctccgattactacatgtcatggatcagacaggccccggggaagggcctcgaatgggtgtcctacatctcgtcctccgggaacaccatctactacgccgacagcgtgaagggccgctttaccatttcccgcgacaacgcaaagaactcgctgtaccttcagatgaattccctgcgggctgaagataccgcggtgtactattgcgcccggtccactatggtccgggaggactactggggacagggcacactcgtgaccgtgtccagcgcgagcgggggtggaggcagcggtggacgcgcctccggcggcggcggttcagacatcgtgctgactcagtcgcccctgtcgctgccggtcaccctgggccaaccggcctcaattagctgcaagtcctcggagagcctggtgcacaactcaggaaagacttacctgaactggttccatcagcggcctggacagtccccacggaggctcatctatgaagtgtccaacagggattcgggggtgcccgaccgcttcactggctccgggtccggcaccgacttcaccttgaaaatctccagagtggaagccgaggacgtgggcgtgtactactgtatgcagggtacccactggcctggaacctttggacaaggaactaagctcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 652 - protein, 239 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 653 - DNA, 717 bp, Artificial Sequence
  source: /note="Description of Artificial Sequence: Synthetic polynucleotide"
caagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaag

SEQ ID NO: 654 - protein, 115 aa, Artificial Sequence
  source: /note="Description of Artificial Sequence: Synthetic polypeptide"
QVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSS

SEQ ID NO: 655 - protein, 107 aa, Artificial Sequence
  source: /note="Description of Artificial Sequence: Synthetic polypeptide"
DIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIK

SEQ ID NO: 656 - protein, 483 aa, Artificial Sequence
  source: /note="Description of Artificial Sequence: Synthetic polypeptide"
MALPVTALLLPLALLLHAARPQVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIRLTQSPSPLSASVGDRVTITCQASEDINKFLNWYHQTPGKAPKLLIYDASTLQTGVPSRFSGSGSGTDFTLTINSLQPEDIGTYYCQQYESLPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 657 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtggaatctggtggaggactcgtgcaacccggtggaagccttaggctgtcgtgcgccgtcagcgggtttgctctgagcaaccatggaatgtcctgggtccgccgggcaccgggaaaagggctggaatgggtgtccggcatcgtgtacagcgggtcaacctattacgccgcgtccgtgaagggcagattcactatctcaagagacaacagccggaacaccctgtacttgcaaatgaattccctgcgccccgaggacaccgccatctactactgctccgcccacggaggagagtcggacgtgtggggccagggaacgactgtgactgtgtccagcgcatcaggagggggtggttcgggcggccgggcctcggggggaggaggttccgacattcggctgacccagtccccgtccccactgtcggcctccgtcggcgaccgcgtgaccatcacttgtcaggcgtccgaggacattaacaagttcctgaactggtaccaccagacccctggaaaggcccccaagctgctgatctacgatgcctcgacccttcaaactggagtgcctagccggttctccgggtccggctccggcactgatttcactctgaccatcaactcattgcagccggaagatatcgggacctactattgccagcagtacgaatccctcccgctcacattcggcgggggaaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 658 - protein, 240 aa, Artificial Sequence
  source: /note="Description of Artificial Sequence: Synthetic polypeptide"
EVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 659 - DNA, 720 bp, Artificial Sequence
  source: /note="Description of Artificial Sequence: Synthetic polynucleotide"
gaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaa

SEQ ID NO: 660 - protein, 108 aa, Artificial Sequence
  source: /note="Description of Artificial Sequence: Synthetic polypeptide"
ETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIK

SEQ ID NO: 661 - protein, 484 aa, Artificial Sequence
  source: /note="Description of Artificial Sequence: Synthetic polypeptide"
MALPVTALLLPLALLLHAARPEVQLVETGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSETTLTQSPATLSVSPGERATLSCRASQSVGSNLAWYQQKPGQGPRLLIYGASTRATGIPARFSGSGSGTEFTLTISSLQPEDFAVYYCQQYNDWLPVTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 662 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaaactggaggaggacttgtgcaacctggaggatcattgcggctctcatgcgctgtctccggcttcgccctgtcaaatcacgggatgtcgtgggtcagacgggccccgggaaagggtctggaatgggtgtcggggattgtgtacagcggctccacctactacgccgcttcggtcaagggccgcttcactatttcacgggacaacagccgcaacaccctctatctgcaaatgaactctctccgcccggaggataccgccatctactactgctccgcacacggcggcgaatccgacgtgtggggacagggaaccactgtcaccgtgtcgtccgcatccggtggcggaggatcgggtggccgggcctccgggggcggcggcagcgagactaccctgacccagtcccctgccactctgtccgtgagcccgggagagagagccacccttagctgccgggccagccagagcgtgggctccaacctggcctggtaccagcagaagccaggacagggtcccaggctgctgatctacggagcctccactcgcgcgaccggcatccccgcgaggttctccgggtcgggttccgggaccgagttcaccctgaccatctcctccctccaaccggaggacttcgcggtgtactactgtcagcagtacaacgattggctgcccgtgacatttggacaggggacgaaggtggaaatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 663 - protein, 241 aa, Artificial Sequence
  source: /note="Description of Artificial Sequence: Synthetic polypeptide"
EVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 664 - DNA, 723 bp, Artificial Sequence
  source: /note="Description of Artificial Sequence: Synthetic polynucleotide"
gaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaag

SEQ ID NO: 665 - protein, 109 aa, Artificial Sequence
  source: /note="Description of Artificial Sequence: Synthetic polypeptide"
EIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIK

SEQ ID NO: 666 - protein, 485 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSEIVLTQSPGTLSLSPGERATLSCRASQSIGSSSLAWYQQKPGQAPRLLMYGASSRASGIPDRFSGSGSGTDFTLTISRLEPEDFAVYYCQQYAGSPPFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 667 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaattggtggaatctggtggaggacttgtgcaacctggaggatcactgagactgtcatgcgcggtgtccggttttgccctgagcaatcatgggatgtcgtgggtccggcgcgcccccggaaagggtctggaatgggtgtcgggtatcgtctactccgggagcacttactacgccgcgagcgtgaagggccgcttcaccatttcccgcgataactcccgcaacaccctgtacttgcaaatgaactcgctccggcctgaggacactgccatctactactgctccgcacacggaggagaatccgacgtgtggggccagggaactaccgtgaccgtcagcagcgcctccggcggcgggggctcaggcggacgggctagcggcggcggtggctccgagatcgtgctgacccagtcgcctggcactctctcgctgagccccggggaaagggcaaccctgtcctgtcgggccagccagtccattggatcatcctccctcgcctggtatcagcagaaaccgggacaggctccgcggctgcttatgtatggggccagctcaagagcctccggcattcccgaccggttctccgggtccggttccggcaccgatttcaccctgactatctcgaggctggagccagaggacttcgccgtgtactactgccagcagtacgcggggtccccgccgttcacgttcggacagggaaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 668 - protein, 243 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 669 - DNA, 729 bp, Artificial Sequence
  source: /note="Description of Artificial Sequence: Synthetic polynucleotide"
caagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaag

SEQ ID NO: 670 - protein, 121 aa, Artificial Sequence
  source: /note="Description of Artificial Sequence: Synthetic polypeptide"
QVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSS

SEQ ID NO: 671 - protein, 107 aa, Artificial Sequence
  source: /note="Description of Artificial Sequence: Synthetic polypeptide"
ETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIK

SEQ ID NO: 672 - protein, 487 aa, Artificial Sequence
  source: /note="Description of Artificial Sequence: Synthetic polypeptide"
MALPVTALLLPLALLLHAARPQVQLQESGPGLVKPSETLSLTCTVSGGSISSSYYYWGWIRQPPGKGLEWIGSIYYSGSAYYNPSLKSRVTISVDTSKNQFSLRLSSVTAADTAVYYCARHWQEWPDAFDIWGQGTMVTVSSGGGGSGGGGSGGGGSETTLTQSPAFMSATPGDKVIISCKASQDIDDAMNWYQQKPGEAPLFIIQSATSPVPGIPPRFSGSGFGTDFSLTINNIESEDAAYYFCLQHDNFPLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 673 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggaaagcggaccgggcctggtcaagccatccgaaactctctccctgacttgcactgtgtctggcggttccatctcatcgtcgtactactactggggctggattaggcagccgcccggaaagggactggagtggatcggaagcatctactattccggctcggcgtactacaaccctagcctcaagtcgagagtgaccatctccgtggatacctccaagaaccagttttccctgcgcctgagctccgtgaccgccgctgacaccgccgtgtactactgtgctcggcattggcaggaatggcccgatgccttcgacatttggggccagggcactatggtcactgtgtcatccgggggtggaggcagcgggggaggagggtccggggggggaggttcagagacaaccttgacccagtcacccgcattcatgtccgccactccgggagacaaggtcatcatctcgtgcaaagcgtcccaggatatcgacgatgccatgaattggtaccagcagaagcctggcgaagcgccgctgttcattatccaatccgcaacctcgcccgtgcctggaatcccaccgcggttcagcggcagcggtttcggaaccgacttttccctgaccattaacaacattgagtccgaggacgccgcctactacttctgcctgcaacacgacaacttccctctcacgttcggccagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 674 - protein, 244 aa, Artificial Sequence
  source: /note="Description of Artificial Sequence: Synthetic polypeptide"
VNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 675 - DNA, 735 bp, Artificial Sequence
  source: /note="Description of Artificial Sequence: Synthetic polynucleotide"
caagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaag

SEQ ID NO: 676 - protein, 123 aa, Artificial Sequence
  source: /note="Description of Artificial Sequence: Synthetic polypeptide"
QVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSS

SEQ ID NO: 677 - protein, 107 aa, Artificial Sequence
  source: /note="Description of Artificial Sequence: Synthetic polypeptide"
DIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIK

SEQ ID NO: 678 - protein, 489 aa, Artificial Sequence
  source: /note="Description of Artificial Sequence: Synthetic polypeptide"
MALPVTALLLPLALLLHAARPQVNLRESGPALVKPTQTLTLTCTFSGFSLRTSGMCVSWIRQPPGKALEWLARIDWDEDKFYSTSLKTRLTISKDTSDNQVVLRMTNMDPADTATYYCARSGAGGTSATAFDIWGPGTMVTVSSGGGGSGGGGSGGGGSDIQMTQSPSSLSASVGDRVTITCRASQDIYNNLAWFQLKPGSAPRSLMYAANKSQSGVPSRFSGSASGTDFTLTISSLQPEDFATYYCQHYYRFPYSFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 679 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtcaatctgcgcgaatccggccccgccttggtcaagcctacccagaccctcactctgacctgtactttctccggcttctccctgcggacttccgggatgtgcgtgtcctggatcagacagcctccgggaaaggccctggagtggctcgctcgcattgactgggatgaggacaagttctactccacctcactcaagaccaggctgaccatcagcaaagatacctctgacaaccaagtggtgctccgcatgaccaacatggacccagccgacactgccacttactactgcgcgaggagcggagcgggcggaacctccgccaccgccttcgatatttggggcccgggtaccatggtcaccgtgtcaagcggaggaggggggtccgggggcggcggttccgggggaggcggatcggacattcagatgactcagtcaccatcgtccctgagcgctagcgtgggcgacagagtgacaatcacttgccgggcatcccaggacatctataacaaccttgcgtggttccagctgaagcctggttccgcaccgcggtcacttatgtacgccgccaacaagagccagtcgggagtgccgtcccggttttccggttcggcctcgggaactgacttcaccctgacgatctccagcctgcaacccgaggatttcgccacctactactgccagcactactaccgctttccctactcgttcggacagggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 680 - protein, 246 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 681 - DNA, 738 bp, Artificial Sequence
  source: /note="Description of Artificial Sequence: Synthetic polynucleotide"
gaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaag

SEQ ID NO: 682 - protein, 119 aa, Artificial Sequence
  source: /note="Description of Artificial Sequence: Synthetic polypeptide"
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSS

SEQ ID NO: 683 - protein, 112 aa, Artificial Sequence
  source: /note="Description of Artificial Sequence: Synthetic polypeptide"
EIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIK

SEQ ID NO: 684 - protein, 490 aa, Artificial Sequence
  source: /note="Description of Artificial Sequence: Synthetic polypeptide"
MALPVTALLLPLALLLHAARPEVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAKTIAAVYAFDIWGQGTTVTVSSGGGGSGGGGSGGGGSEIVLTQSPLSLPVTPEEPASISCRSSQSLLHSNGYNYLDWYLQKPGQSPQLLIYLGSNRASGVPDRFSGSGSGTDFTLKISRVEAEDVGVYYCMQALQTPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 685 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagcttgtcgaatccggggggggactggtcaagccgggcggatcactgagactgtcctgcgccgcgagcggcttcacgttctcctcctactccatgaactgggtccgccaagcccccgggaagggactggaatgggtgtcctctatctcctcgtcgtcgtcctacatctactacgccgactccgtgaagggaagattcaccatttcccgcgacaacgcaaagaactcactgtacttgcaaatgaactcactccgggccgaagatactgctgtgtactattgcgccaagactattgccgccgtctacgctttcgacatctggggccagggaaccaccgtgactgtgtcgtccggtggtggtggctcgggcggaggaggaagcggcggcggggggtccgagattgtgctgacccagtcgccactgagcctccctgtgacccccgaggaacccgccagcatcagctgccggtccagccagtccctgctccactccaacggatacaattacctcgattggtaccttcagaagcctggacaaagcccgcagctgctcatctacttgggatcaaaccgcgcgtcaggagtgcctgaccggttctccggctcgggcagcggtaccgatttcaccctgaaaatctccagggtggaggcagaggacgtgggagtgtattactgtatgcaggcgctgcagactccgtacacatttgggcagggcaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 686 - protein, 240 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 687 - DNA, 720 bp, Artificial Sequence
  source: /note="Description of Artificial Sequence: Synthetic polynucleotide"
gaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctc

SEQ ID NO: 688 - protein, 117 aa, Artificial Sequence
  source: /note="Description of Artificial Sequence: Synthetic polypeptide"
EVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSS

SEQ ID NO: 689 - protein, 108 aa, Artificial Sequence
  source: /note="Description of Artificial Sequence: Synthetic polypeptide"
SYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVL

SEQ ID NO: 690 - protein, 484 aa, Artificial Sequence
  source: /note="Description of Artificial Sequence: Synthetic polypeptide"
MALPVTALLLPLALLLHAARPEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLRGAFDIWGQGTMVTVSSGGGGSGGGGSGGGGSSYVLTQSPSVSAAPGYTATISCGGNNIGTKSVHWYQQKPGQAPLLVIRDDSVRPSKIPGRFSGSNSGNMATLTISGVQAGDEADFYCQVWDSDSEHVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 691 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgaagtccagctcgtggagtccggcggaggccttgtgaagcctggaggttcgctgagactgtcctgcgccgcctccggcttcaccttctccgactactacatgtcctggatcagacaggccccgggaaagggcctggaatgggtgtcctacatctcgtcatcgggcagcactatctactacgcggactcagtgaaggggcggttcaccatttcccgggataacgcgaagaactcgctgtatctgcaaatgaactcactgagggccgaggacaccgccgtgtactactgcgcccgcgatctccgcggggcatttgacatctggggacagggaaccatggtcacagtgtccagcggagggggaggatcgggtggcggaggttccgggggtggaggctcctcctacgtgctgactcagagcccaagcgtcagcgctgcgcccggttacacggcaaccatctcctgtggcggaaacaacattgggaccaagtctgtgcactggtatcagcagaagccgggccaagctcccctgttggtgatccgcgatgactccgtgcggcctagcaaaattccgggacggttctccggctccaacagcggcaatatggccactctcaccatctcgggagtgcaggccggagatgaagccgacttctactgccaagtctgggactcagactccgagcatgtggtgttcgggggcggaaccaagctgactgtgctcaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 692 - protein, 241 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 693 - DNA, 723 bp, Artificial Sequence
  source: /note="Description of Artificial Sequence: Synthetic polynucleotide"
caagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtcctt

SEQ ID NO: 694 - protein, 120 aa, Artificial Sequence
  source: /note="Description of Artificial Sequence: Synthetic polypeptide"
QVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSS

SEQ ID NO: 695 - protein, 106 aa, Artificial Sequence
  source: /note="Description of Artificial Sequence: Synthetic polypeptide"
SYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVL

SEQ ID NO: 696 - protein, 485 aa, Artificial Sequence
  source: /note="Description of Artificial Sequence: Synthetic polypeptide"
MALPVTALLLPLALLLHAARPQVQLVQSGAEVKKPGASVKVSCKPSGYTVTSHYIHWVRRAPGQGLEWMGMINPSGGVTAYSQTLQGRVTMTSDTSSSTVYMELSSLRSEDTAMYYCAREGSGSGWYFDFWGRGTLVTVSSGGGGSGGGGSGGGGSSYVLTQPPSVSVSPGQTASITCSGDGLSKKYVSWYQQKAGQSPVVLISRDKERPSGIPDRFSGSNSADTATLTISGTQAMDEADYYCQAWDDTTVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 697 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtgcagagcggggccgaagtcaagaagccgggagcctccgtgaaagtgtcctgcaagccttcgggatacaccgtgacctcccactacattcattgggtccgccgcgcccccggccaaggactcgagtggatgggcatgatcaaccctagcggcggagtgaccgcgtacagccagacgctgcagggacgcgtgactatgacctcggatacctcctcctccaccgtctatatggaactgtccagcctgcggtccgaggataccgccatgtactactgcgcccgggaaggatcaggctccgggtggtatttcgacttctggggaagaggcaccctcgtgactgtgtcatctgggggagggggttccggtggtggcggatcgggaggaggcggttcatcctacgtgctgacccagccaccctccgtgtccgtgagccccggccagactgcatcgattacatgtagcggcgacggcctctccaagaaatacgtgtcgtggtaccagcagaaggccggacagagcccggtggtgctgatctcaagagataaggagcggcctagcggaatcccggacaggttctcgggttccaactccgcggacactgctactctgaccatctcggggacccaggctatggacgaagccgattactactgccaagcctgggacgacactactgtcgtgtttggagggggcaccaagttgaccgtccttaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 698 - protein, 245 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 699 - DNA, 735 bp, Artificial Sequence
  source: /note="Description of Artificial Sequence: Synthetic polynucleotide"
caagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaag

SEQ ID NO: 700 - protein, 123 aa, Artificial Sequence
  source: /note="Description of Artificial Sequence: Synthetic polypeptide"
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSS

SEQ ID NO: 701 - protein, 107 aa, Artificial Sequence
  source: /note="Description of Artificial Sequence: Synthetic polypeptide"
DIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIK

SEQ ID NO: 702 - protein, 489 aa, Artificial Sequence
  source: /note="Description of Artificial Sequence: Synthetic polypeptide"
MALPVTALLLPLALLLHAARPQVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAGIAARLRGAFDIWGQGTMVTVSSGGGGSGGGGSGGGGSDIVMTQSPSSVSASVGDRVIITCRASQGIRNWLAWYQQKPGKAPNLLIYAASNLQSGVPSRFSGSGSGADFTLTISSLQPEDVATYYCQKYNSAPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 703 - DNA, 1467 bp, Artificial Sequence
  source: /note="Description of Artificial Sequence: Synthetic polynucleotide"
atggccctccctgtcaccgccctgctgcttccgctggctcttctgctccacgccgctcggccccaagtgcagcttcaggagagcggcccgggactcgtgaagccgtcccagaccctgtccctgacttgcaccgtgtcgggaggaagcatctcgagcggaggctactattggtcgtggattcggcagcaccctggaaagggcctggaatggatcggctacatctactactccggctcgacctactacaacccatcgctgaagtccagagtgacaatctcagtggacacgtccaagaatcagttcagcctgaagctctcttccgtgactgcggccgacaccgccgtgtactactgcgcacgcgctggaattgccgcccggctgaggggtgccttcgacatttggggacagggcaccatggtcaccgtgtcctccggcggcggaggttccgggggtggaggctcaggaggaggggggtccgacatcgtcatgactcagtcgccctcaagcgtcagcgcgtccgtcggggacagagtgatcatcacctgtcgggcgtcccagggaattcgcaactggctggcctggtatcagcagaagcccggaaaggcccccaacctgttgatctacgccgcctcaaacctccaatccggggtgccgagccgcttcagcggctccggttcgggtgccgatttcactctgaccatctcctccctgcaacctgaagatgtggctacctactactgccaaaagtacaactccgcaccttttactttcggaccggggaccaaagtggacattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 704 - protein, 253 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 705 - DNA, 759 bp, Artificial Sequence
  source: /note="Description of Artificial Sequence: Synthetic polynucleotide"
caagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctg

SEQ ID NO: 706 - protein, 129 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSS

SEQ ID NO: 707 - protein, 109 aa, Artificial Sequence
  source: /note="Description of Artificial Sequence: Synthetic polypeptide"
SYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVL

SEQ ID NO: 708 - protein, 497 aa, Artificial Sequence
  source: /note="Description of Artificial Sequence: Synthetic polypeptide"
MALPVTALLLPLALLLHAARPQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARRGGYQLLRWDVGLLRSAFDIWGQGTMVTVSSGGGGSGGGGSGGGGSSYVLTQPPSVSVAPGQTARITCGGNNIGSKSVHWYQQKPGQAPVLVLYGKNNRPSGVPDRFSGSRSGTTASLTITGAQAEDEADYYCSSRDSSGDHLRVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 709 - DNA, 1491 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctggtccagtcgggcgccgaggtcaagaagcccgggagctctgtgaaagtgtcctgcaaggcctccgggggcacctttagctcctacgccatctcctgggtccgccaagcaccgggtcaaggcctggagtggatggggggaattatccctatcttcggcactgccaactacgcccagaagttccagggacgcgtgaccattaccgcggacgaatccacctccaccgcttatatggagctgtccagcttgcgctcggaagataccgccgtgtactactgcgcccggaggggtggataccagctgctgagatgggacgtgggcctcctgcggtcggcgttcgacatctggggccagggcactatggtcactgtgtccagcggaggaggcggatcgggaggcggcggatcagggggaggcggttccagctacgtgcttactcaacccccttcggtgtccgtggccccgggacagaccgccagaatcacttgcggaggaaacaacattgggtccaagagcgtgcattggtaccagcagaagccaggacaggcccctgtgctggtgctctacgggaagaacaatcggcccagcggagtgccggacaggttctcgggttcacgctccggtacaaccgcttcactgactatcaccggggcccaggcagaggatgaagcggactactactgttcctcccgggattcatccggcgaccacctccgggtgttcggaaccggaacgaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 710 - protein, 248 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 711 - DNA, 744 bp, Artificial Sequence
  source: /note="Description of Artificial Sequence: Synthetic polynucleotide"
gaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctg

SEQ ID NO: 712 - protein, 125 aa, Artificial Sequence
  source: /note="Description of Artificial Sequence: Synthetic polypeptide"
EVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSS

SEQ ID NO: 713 - protein, 108 aa, Artificial Sequence
  source: /note="Description of Artificial Sequence: Synthetic polypeptide"
SSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVL

SEQ ID NO: 714 - protein, 492 aa, Artificial Sequence
  source: /note="Description of Artificial Sequence: Synthetic polypeptide"
MALPVTALLLPLALLLHAARPEVQLQQSGPGLVKPSQTLSLTCAISGDSVSSNSAAWNWIRQSPSRGLEWLGRTYYRSKWYSFYAISLKSRIIINPDTSKNQFSLQLKSVTPEDTAVYYCARSSPEGLFLYWFDPWGQGTLVTVSSGGDGSGGGGSGGGGSSSELTQDPAVSVALGQTIRITCQGDSLGNYYATWYQQKPGQAPVLVIYGTNNRPSGIPDRFSASSSGNTASLTITGAQAEDEADYYCNSRDSSGHHLLFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 715 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctccaacagtcaggaccggggctcgtgaagccatcccagaccctgtccctgacttgtgccatctcgggagatagcgtgtcatcgaactccgccgcctggaactggattcggcagagcccgtcccgcggactggagtggcttggaaggacctactaccggtccaagtggtactctttctacgcgatctcgctgaagtcccgcattatcattaaccctgatacctccaagaatcagttctccctccaactgaaatccgtcacccccgaggacacagcagtgtattactgcgcacggagcagccccgaaggactgttcctgtattggtttgacccctggggccaggggactcttgtgaccgtgtcgagcggcggagatgggtccggtggcggtggttcggggggcggcggatcatcatccgaactgacccaggacccggctgtgtccgtggcgctgggacaaaccatccgcattacgtgccagggagactccctgggcaactactacgccacttggtaccagcagaagccgggccaagcccctgtgttggtcatctacgggaccaacaacagaccttccggcatccccgaccggttcagcgcttcgtcctccggcaacactgccagcctgaccatcactggagcgcaggccgaagatgaggccgactactactgcaacagcagagactcctcgggtcatcacctcttgttcggaactggaaccaaggtcaccgtgctgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 716 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 717 - DNA, 738 bp, Artificial Sequence
  source: /note="Description of Artificial Sequence: Synthetic polynucleotide"
gaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaag

SEQ ID NO: 718 - protein, 118 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSS

SEQ ID NO: 719 - protein, 113 aa, Artificial Sequence
  source: /note="Description of Artificial Sequence: Synthetic polypeptide"
EIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIK

SEQ ID NO: 720 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVEGSGSLDYWGQGTLVTVSSGGGGSGGGGSGGGGSEIVMTQSPGTLSLSPGERATLSCRASQSVSSAYLAWYQQKPGQPPRLLISGASTRATGIPDRFGGSGSGTDFTLTISRLEPEDFAVYYCQHYGSSFNGSSLFTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 721 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagtcaggaggcggcctggtccagccgggagggtcccttagactgtcatgcgccgcaagcggattcactttctcctcctatgccatgagctgggtccgccaagcccccggaaagggactggaatgggtgtccgccatctcggggtctggaggctcaacttactacgctgactccgtgaagggacggttcaccattagccgcgacaactccaagaacaccctctacctccaaatgaactccctgcgggccgaggataccgccgtctactactgcgccaaagtggaaggttcaggatcgctggactactggggacagggtactctcgtgaccgtgtcatcgggcggaggaggttccggcggtggcggctccggcggcggagggtcggagatcgtgatgacccagagccctggtactctgagcctttcgccgggagaaagggccaccctgtcctgccgcgcttcccaatccgtgtcctccgcgtacttggcgtggtaccagcagaagccgggacagccccctcggctgctgatcagcggggccagcacccgggcaaccggaatcccagacagattcgggggttccggcagcggcacagatttcaccctgactatttcgaggttggagcccgaggactttgcggtgtattactgtcagcactacgggtcgtcctttaatggctccagcctgttcacgttcggacaggggacccgcctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 722 - protein, 241 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 723 - DNA, 723 bp, Artificial Sequence
  source: /note="Description of Artificial Sequence: Synthetic polynucleotide"
gaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaag

SEQ ID NO: 724 - protein, 118 aa, Artificial Sequence
  source: /note="Description of Artificial Sequence: Synthetic polypeptide"
EVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSS

SEQ ID NO: 725 - protein, 108 aa, Artificial Sequence
  source: /note="Description of Artificial Sequence: Synthetic polypeptide"
EIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIK

SEQ ID NO: 726 - protein, 485 aa, Artificial Sequence
  source: /note="Description of Artificial Sequence: Synthetic polypeptide"
MALPVTALLLPLALLLHAARPEVQLVETGGGLVQPGGSLRLSCAASGITFSRYPMSWVRQAPGKGLEWVSGISDSGVSTYYADSAKGRFTISRDNSKNTLFLQMSSLRDEDTAVYYCVTRAGSEASDIWGQGTMVTVSSGGGGSGGGGSGGGGSEIVLTQSPATLSLSPGERATLSCRASQSVSNSLAWYQQKPGQAPRLLIYDASSRATGIPDRFSGSGSGTDFTLTISRLEPEDFAIYYCQQFGTSSGLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 727 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggcggcctggtgcagcctggaggatcattgaggctgtcatgcgcggccagcggtattaccttctcccggtaccccatgtcctgggtcagacaggccccggggaaagggcttgaatgggtgtccgggatctcggactccggtgtcagcacttactacgccgactccgccaagggacgcttcaccatttcccgggacaactcgaagaacaccctgttcctccaaatgagctccctccgggacgaggatactgcagtgtactactgcgtgacccgcgccgggtccgaggcgtctgacatttggggacagggcactatggtcaccgtgtcgtccggcggagggggctcgggaggcggtggcagcggaggaggagggtccgagatcgtgctgacccaatccccggccaccctctcgctgagccctggagaaagggcaaccttgtcctgtcgcgcgagccagtccgtgagcaactccctggcctggtaccagcagaagcccggacaggctccgagacttctgatctacgacgcttcgagccgggccactggaatccccgaccgcttttcggggtccggctcaggaaccgatttcaccctgacaatctcacggctggagccagaggatttcgccatctattactgccagcagttcggtacttcctccggcctgactttcggaggcggcacgaagctcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 728 - protein, 248 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 729 - DNA, 744 bp, Artificial Sequence
  source: /note="Description of Artificial Sequence: Synthetic polynucleotide"
caagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaag

SEQ ID NO: 730 - protein, 124 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSS

SEQ ID NO: 731 - protein, 109 aa, Artificial Sequence
  source: /note="Description of Artificial Sequence: Synthetic polypeptide"
EIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIK

SEQ ID NO: 732 - protein, 492 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNAKNSLYLQMNSLRAEDTAIYYCARATYKRELRYYYGMDVWGQGTMVTVSSGGGGSGGGGSGGGGSEIVMTQSPGTVSLSPGERATLSCRASQSVSSSFLAWYQQKPGQAPRLLIYGASSRATGIPDRFSGSGSGTDFTLTISRLEPEDSAVYYCQQYHSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 733 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggaatcgggtggcggactggtgcagccggggggctcacttagactgtcctgcgcggccagcggattcactttctcctcctacgccatgtcctgggtcagacaggcccctggaaagggcctggaatgggtgtccgcaatcagcggcagcggcggctcgacctattacgcggattcagtgaagggcagattcaccatttcccgggacaacgccaagaactccttgtaccttcaaatgaactccctccgcgcggaagataccgcaatctactactgcgctcgggccacttacaagagggaactgcgctactactacgggatggacgtctggggccagggaaccatggtcaccgtgtccagcggaggaggaggatcgggaggaggcggtagcgggggtggagggtcggagatcgtgatgacccagtcccccggcactgtgtcgctgtcccccggcgaacgggccaccctgtcatgtcgggccagccagtcagtgtcgtcaagcttcctcgcctggtaccagcagaaaccgggacaagctccccgcctgctgatctacggagccagcagccgggccaccggtattcctgaccggttctccggttcggggtccgggaccgactttactctgactatctctcgcctcgagccagaggactccgccgtgtattactgccagcagtaccactcctccccgtcctggacgttcggacagggcacaaggctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 734 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 735 - DNA, 744 bp, Artificial Sequence
  source: /note="Description of Artificial Sequence: Synthetic polynucleotide"
gaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaag

SEQ ID NO: 736 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSS

SEQ ID NO: 737 - protein, 109 aa, Artificial Sequence
  source: /note="Description of Artificial Sequence: Synthetic polypeptide"
EIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIK

SEQ ID NO: 738 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTISRDNSKNTLYLQMNTLKAEDTAVYYCARATYKRELRYYYGMDVWGQGTTVTVSSGGGGSGGGGSGGGGSEIVLTQSPSTLSLSPGESATLSCRASQSVSTTFLAWYQQKPGQAPRLLIYGSSNRATGIPDRFSGSGSGTDFTLTIRRLEPEDFAVYYCQQYHSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 739 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagcttgtggaaaccggtggcggactggtgcagcccggaggaagcctcaggctgtcctgcgccgcgtccggcttcaccttctcctcgtacgccatgtcctgggtccgccaggcccccggaaagggcctggaatgggtgtccgccatctctggaagcggaggttccacgtactacgcggacagcgtcaagggaaggttcacaatctcccgcgataattcgaagaacactctgtaccttcaaatgaacaccctgaaggccgaggacactgctgtgtactactgcgcacgggccacctacaagagagagctccggtactactacggaatggacgtctggggccagggaactactgtgaccgtgtcctcgggagggggtggctccggggggggcggctccggcggaggcggttccgagattgtgctgacccagtcaccttcaactctgtcgctgtccccgggagagagcgctactctgagctgccgggccagccagtccgtgtccaccaccttcctcgcctggtatcagcagaagccggggcaggcaccacggctcttgatctacgggtcaagcaacagagcgaccggaattcctgaccgcttctcggggagcggttcaggcaccgacttcaccctgactatccggcgcctggaacccgaagatttcgccgtgtattactgtcaacagtaccactcctcgccgtcctggacctttggccaaggaaccaaagtggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 740 - protein, 239 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 741 - DNA, 717 bp, Artificial Sequence
  source: /note="Description of Artificial Sequence: Synthetic polynucleotide"
gaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaag

SEQ ID NO: 742 - protein, 117 aa, Artificial Sequence
  source: /note="Description of Artificial Sequence: Synthetic polypeptide"
EVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSS

SEQ ID NO: 743 - protein, 107 aa, Artificial Sequence
  source: /note="Description of Artificial Sequence: Synthetic polypeptide"
DIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIK

SEQ ID NO: 744 - protein, 483 aa, Artificial Sequence
  source: /note="Description of Artificial Sequence: Synthetic polypeptide"
MALPVTALLLPLALLLHAARPEVQLVETGGGLVQPGRSLRLSCAASGFTFDDYAMHWVRQAPGKGLEWVSGISWNSGSIGYADSVKGRFTISRDNAKNSLYLQMNSLRDEDTAVYYCARVGKAVPDVWGQGTTVTVSSGGGGSGGGGSGGGGSDIVMTQTPSSLSASVGDRVTITCRASQSISSYLNWYQQKPGKAPKLLIYAASSLQSGVPSRFSGSGSGTDFTLTISSLQPEDFATYYCQQSYSTPYSFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 745 - DNA, 1449 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggaaactggaggtggactcgtgcagcctggacggtcgctgcggctgagctgcgctgcatccggcttcaccttcgacgattatgccatgcactgggtcagacaggcgccagggaagggacttgagtgggtgtccggtatcagctggaatagcggctcaatcggatacgcggactccgtgaagggaaggttcaccatttcccgcgacaacgccaagaactccctgtacttgcaaatgaacagcctccgggatgaggacactgccgtgtactactgcgcccgcgtcggaaaagctgtgcccgacgtctggggccagggaaccactgtgaccgtgtccagcggcgggggtggatcgggcggtggagggtccggtggagggggctcagatattgtgatgacccagaccccctcgtccctgtccgcctcggtcggcgaccgcgtgactatcacatgtagagcctcgcagagcatctccagctacctgaactggtatcagcagaagccggggaaggccccgaagctcctgatctacgcggcatcatcactgcaatcgggagtgccgagccggttttccgggtccggctccggcaccgacttcacgctgaccatttcttccctgcaacccgaggacttcgccacttactactgccagcagtcctactccaccccttactccttcggccaaggaaccaggctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 746 - protein, 246 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 747 - DNA, 738 bp, Artificial Sequence
  source: /note="Description of Artificial Sequence: Synthetic polynucleotide"
gaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaag

SEQ ID NO: 748 - protein, 122 aa, Artificial Sequence
  source: /note="Description of Artificial Sequence: Synthetic polypeptide"
EVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSS

SEQ ID NO: 749 - protein, 109 aa, Artificial Sequence
  source: /note="Description of Artificial Sequence: Synthetic polypeptide"
EIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIK

SEQ ID NO: 750 - protein, 490 aa, Artificial Sequence
  source: /note="Description of Artificial Sequence: Synthetic polypeptide"
MALPVTALLLPLALLLHAARPEVQLVESGGGLVQPGRSLRLSCTASGFTFDDYAMHWVRQRPGKGLEWVASINWKGNSLAYGDSVKGRFAISRDNAKNTVFLQMNSLRTEDTAVYYCASHQGVAYYNYAMDVWGRGTLVTVSSGGGGSGGGGSGGGGSEIVLTQSPGTLSLSPGERATLSCRATQSIGSSFLAWYQQRPGQAPRLLIYGASQRATGIPDRFSGRGSGTDFTLTISRVEPEDSAVYYCQHYESSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 751 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctcgtggagagcgggggaggattggtgcagcccggaaggtccctgcggctctcctgcactgcgtctggcttcaccttcgacgactacgcgatgcactgggtcagacagcgcccgggaaagggcctggaatgggtcgcctcaatcaactggaagggaaactccctggcctatggcgacagcgtgaagggccgcttcgccatttcgcgcgacaacgccaagaacaccgtgtttctgcaaatgaattccctgcggaccgaggataccgctgtgtactactgcgccagccaccagggcgtggcatactataactacgccatggacgtgtggggaagagggacgctcgtcaccgtgtcctccgggggcggtggatcgggtggaggaggaagcggtggcgggggcagcgaaatcgtgctgactcagagcccgggaactctttcactgtccccgggagaacgggccactctctcgtgccgggccacccagtccatcggctcctccttccttgcctggtaccagcagaggccaggacaggcgccccgcctgctgatctacggtgcttcccaacgcgccactggcattcctgaccggttcagcggcagagggtcgggaaccgatttcacactgaccatttcccgggtggagcccgaagattcggcagtctactactgtcagcattacgagtcctccccttcatggaccttcggtcaagggaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 752 - protein, 241 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 753 - DNA, 723 bp, Artificial Sequence
  source: /note="Description of Artificial Sequence: Synthetic polynucleotide"
gaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaag

SEQ ID NO: 754 - protein, 117 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSS

SEQ ID NO: 755 - protein, 109 aa, Artificial Sequence
  source: /note="Description of Artificial Sequence: Synthetic polypeptide"
EIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIK

SEQ ID NO: 756 - protein, 485 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVVRDGMDVWGQGTTVTVSSGGGGSGGGGSGGGGSEIVLTQSPATLSLSPGERATLSCRASQSVSSSYLAWYQQKPGQAPRLLIYGASSRATGIPDRFSGNGSGTDFTLTISRLEPEDFAVYYCQQYGSPPRFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 757 - DNA, 1455 bp, Artificial Sequence
  source: /note="Description of Artificial Sequence: Synthetic polynucleotide"
atggccctccctgtcaccgccctgctgcttccgctggctcttctgctccacgccgctcggcccgaggtgcagttggtcgaaagcgggggcgggcttgtgcagcctggcggatcactgcggctgtcctgcgcggcatcaggcttcacgttttcttcctacgccatgtcctgggtgcgccaggcccctggaaagggactggaatgggtgtccgcgatttcggggtccggcgggagcacctactacgccgattccgtgaagggccgcttcactatctcgcgggacaactccaagaacaccctctacctccaaatgaatagcctgcgggccgaggataccgccgtctactattgcgctaaggtcgtgcgcgacggaatggacgtgtggggacagggtaccaccgtgacagtgtcctcggggggaggcggtagcggcggaggaggaagcggtggtggaggttccgagattgtgctgactcaatcacccgcgaccctgagcctgtcccccggcgaaagggccactctgtcctgtcgggccagccaatcagtctcctcctcgtacctggcctggtaccagcagaagccaggacaggctccgagactccttatctatggcgcatcctcccgcgccaccggaatcccggataggttctcgggaaacggatcggggaccgacttcactctcaccatctcccggctggaaccggaggacttcgccgtgtactactgccagcagtacggcagcccgcctagattcactttcggccccggcaccaaagtggacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 758 - protein, 242 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 759 - DNA, 726 bp, Artificial Sequence
  source: /note="Description of Artificial Sequence: Synthetic polynucleotide"
gaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaag

SEQ ID NO: 760 - protein, 118 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSS

SEQ ID NO: 761 - protein, 109 aa, Artificial Sequence
  source: /note="Description of Artificial Sequence: Synthetic polypeptide"
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIK

SEQ ID NO: 762 - protein, 486 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKIPQTGTFDYWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISRLEPEDFAVYYCQHYGSSPSWTFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 763 - DNA, 1458 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctggagtccggcggtggattggtgcaaccggggggatcgctcagactgtcctgtgcggcgtcaggcttcaccttctcgagctacgccatgtcatgggtcagacaggcccctggaaagggtctggaatgggtgtccgccatttccgggagcgggggatctacatactacgccgatagcgtgaagggccgcttcaccatttcccgggacaactccaagaacactctctatctgcaaatgaactccctccgcgctgaggacactgccgtgtactactgcgccaaaatccctcagaccggcaccttcgactactggggacaggggactctggtcaccgtcagcagcggtggcggaggttcggggggaggaggaagcggcggcggagggtccgagattgtgctgacccagtcacccggcactttgtccctgtcgcctggagaaagggccaccctttcctgccgggcatcccaatccgtgtcctcctcgtacctggcctggtaccagcagaggcccggacaggccccacggcttctgatctacggagcaagcagccgcgcgaccggtatcccggaccggttttcgggctcgggctcaggaactgacttcaccctcaccatctcccgcctggaacccgaagatttcgctgtgtattactgccagcactacggcagctccccgtcctggacgttcggccagggaactcggctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 764 - protein, 248 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 765 - DNA, 744 bp, Artificial Sequence
  source: /note="Description of Artificial Sequence: Synthetic polynucleotide"
gaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaag

SEQ ID NO: 766 - protein, 124 aa, Artificial Sequence
  source: /note="Description of Artificial Sequence: Synthetic polypeptide"
EVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSS

SEQ ID NO: 767 - protein, 109 aa, Artificial Sequence
  source: /note="Description of Artificial Sequence: Synthetic polypeptide"
EIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIK

SEQ ID NO: 768 - protein, 492 aa, Artificial Sequence
  source: /note="Description of Artificial Sequence: Synthetic polypeptide"
MALPVTALLLPLALLLHAARPEVQLVETGGGLVQPGGSLRLSCAASGFTFSSYAMSWVRQAPGKGLEWVSAISGSGGSTYYADSVKGRFTMSRENDKNSVFLQMNSLRVEDTGVYYCARANYKRELRYYYGMDVWGQGTMVTVSSGGGGSGGGGSGGGGSEIVMTQSPGTLSLSPGESATLSCRASQRVASNYLAWYQHKPGQAPSLLISGASSRATGVPDRFSGSGSGTDFTLAISRLEPEDSAVYYCQHYDSSPSWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 769 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggcccgaagtgcaactggtggaaaccggtggaggactcgtgcagcctggcggcagcctccggctgagctgcgccgcttcgggattcaccttttcctcctacgcgatgtcttgggtcagacaggcccccggaaaggggctggaatgggtgtcagccatctccggctccggcggatcaacgtactacgccgactccgtgaaaggccggttcaccatgtcgcgcgagaatgacaagaactccgtgttcctgcaaatgaactccctgagggtggaggacaccggagtgtactattgtgcgcgcgccaactacaagagagagctgcggtactactacggaatggacgtctggggacagggaactatggtgaccgtgtcatccggtggagggggaagcggcggtggaggcagcgggggcgggggttcagaaattgtcatgacccagtccccgggaactctttccctctcccccggggaatccgcgactttgtcctgccgggccagccagcgcgtggcctcgaactacctcgcatggtaccagcataagccaggccaagccccttccctgctgatttccggggctagcagccgcgccactggcgtgccggataggttctcgggaagcggctcgggtaccgatttcaccctggcaatctcgcggctggaaccggaggattcggccgtgtactactgccagcactatgactcatccccctcctggacattcggacagggcaccaaggtcgagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 770 - protein, 244 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 771 - DNA, 732 bp, Artificial Sequence
  source: /note="Description of Artificial Sequence: Synthetic polynucleotide"
gaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaag

SEQ ID NO: 772 - protein, 120 aa, Artificial Sequence
  source: /note="Description of Artificial Sequence: Synthetic polypeptide"
EVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSS

SEQ ID NO: 773 - protein, 109 aa, Artificial Sequence
  source: /note="Description of Artificial Sequence: Synthetic polypeptide"
EIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIK

SEQ ID NO: 774 - protein, 488 aa, Artificial Sequence
  source: /note="Description of Artificial Sequence: Synthetic polypeptide"
MALPVTALLLPLALLLHAARPEVQLLETGGGLVQPGGSLRLSCAASGFSFSSYAMSWVRQAPGKGLEWVSAISGSGGSTYYADSVKGRFTISRDNSKNTLYLQMNSLRAEDTAVYYCAKALVGATGAFDIWGQGTLVTVSSGGGGSGGGGSGGGGSEIVLTQSPGTLSLSPGERATLSCRASQSLSSNFLAWYQQKPGQAPGLLIYGASNWATGTPDRFSGSGSGTDFTLTITRLEPEDFAVYYCQYYGTSPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 775 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgctcgaaaccggtggagggctggtgcagccagggggctccctgaggctttcatgcgccgctagcggattctccttctcctcttacgccatgtcgtgggtccgccaagcccctggaaaaggcctggaatgggtgtccgcgatttccgggagcggaggttcgacctattacgccgactccgtgaagggccgctttaccatctcccgggataactccaagaacactctgtacctccaaatgaactcgctgagagccgaggacaccgccgtgtattactgcgcgaaggcgctggtcggcgcgactggggcattcgacatctggggacagggaactcttgtgaccgtgtcgagcggaggcggcggctccggcggaggagggagcgggggcggtggttccgaaatcgtgttgactcagtccccgggaaccctgagcttgtcacccggggagcgggccactctctcctgtcgcgcctcccaatcgctctcatccaatttcctggcctggtaccagcagaagcccggacaggccccgggcctgctcatctacggcgcttcaaactgggcaacgggaacccctgatcggttcagcggaagcggatcgggtactgactttaccctgaccatcaccagactggaaccggaggacttcgccgtgtactactgccagtactacggcacctcccccatgtacacattcggacagggtaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 776 - protein, 244 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 777 - DNA, 733 bp, Artificial Sequence
  source: /note="Description of Artificial Sequence: Synthetic polynucleotide"
gaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaaga

SEQ ID NO: 778 - protein, 117 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSS

SEQ ID NO: 779 - protein, 112 aa, Artificial Sequence
  source: /note="Description of Artificial Sequence: Synthetic polypeptide"
DIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIK

SEQ ID NO: 780 - protein, 488 aa, Artificial Sequence
  source: /note="Description of Artificial Sequence: Synthetic polypeptide"
MALPVTALLLPLALLLHAARPEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCVLWFGEGFDPWGQGTLVTVSSGGGGSGGGGSGGGGSDIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 781 - DNA, 1464 bp, Artificial Sequence
  source: /note="Description of Artificial Sequence: Synthetic polynucleotide"
atggccctccctgtcaccgccctgctgcttccgctggctcttctgctccacgccgctcggcccgaagtgcagctgcttgagagcggtggaggtctggtgcagcccgggggatcactgcgcctgtcctgtgccgcgtccggtttcactttctcctcgtacgccatgtcgtgggtcagacaggcaccgggaaagggactggaatgggtgtcagccatttcgggttcggggggcagcacctactacgctgactccgtgaagggccggttcaccatttcccgcgacaactccaagaacaccttgtacctccaaatgaactccctgcgggccgaagataccgccgtgtattactgcgtgctgtggttcggagagggattcgacccgtggggacaaggaacactcgtgactgtgtcatccggcggaggcggcagcggtggcggcggttccggcggcggcggatctgacatcgtgttgacccagtcccctctgagcctgccggtcactcctggcgaaccagccagcatctcctgccggtcgagccagtccctcctgcactccaatgggtacaactacctcgattggtatctgcaaaagccgggccagagcccccagctgctgatctaccttgggtcaaaccgcgcttccggggtgcctgatagattctccgggtccgggagcggaaccgactttaccctgaaaatctcgagggtggaggccgaggacgtcggagtgtactactgcatgcaggcgctccagactcccctgaccttcggaggaggaacgaaggtcgacatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 782 - protein, 251 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 783 - DNA, 753 bp, Artificial Sequence
  source: /note="Description of Artificial Sequence: Synthetic polynucleotide"
caagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaag

SEQ ID NO: 784 - protein, 126 aa, Artificial Sequence
  source: /note="Description of Artificial Sequence: Synthetic polypeptide"
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSS

SEQ ID NO: 785 - protein, 110 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIK

SEQ ID NO: 786 - protein, 495 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGYDSSGYYRDYYGMDVWGQGTTVTVSSGGGGSGGGGSGGGGSEIVLTQSPGTLSLSPGERATLSCRASQSVSSSYLAWYQQKPGQAPRLLIYGTSSRATGISDRFSGSGSGTDFTLTISRLEPEDFAVYYCQHYGNSPPKFTFGPGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 787 - DNA, 1485 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtggagtcaggcggaggactggtgcagcccgggggctccctgagactttcctgcgcggcatcgggttttaccttctcctcctatgctatgtcctgggtgcgccaggccccgggaaagggactggaatgggtgtccgcaatcagcggtagcgggggctcaacatactacgccgactccgtcaagggtcgcttcactatttcccgggacaactccaagaataccctgtacctccaaatgaacagcctcagggccgaggatactgccgtgtactactgcgccaaagtcggatacgatagctccggttactaccgggactactacggaatggacgtgtggggacagggcaccaccgtgaccgtgtcaagcggcggaggcggttcaggagggggaggctccggcggtggagggtccgaaatcgtcctgactcagtcgcctggcactctgtcgttgtccccgggggagcgcgctaccctgtcgtgtcgggcgtcgcagtccgtgtcgagctcctacctcgcgtggtaccagcagaagcccggacaggcccctagacttctgatctacggcacttcttcacgcgccaccgggatcagcgacaggttcagcggctccggctccgggaccgacttcaccctgaccattagccggctggagcctgaagatttcgccgtgtattactgccaacactacggaaactcgccgccaaagttcacgttcggacccggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 788 - protein, 246 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 789 - DNA, 739 bp, Artificial Sequence
  source: /note="Description of Artificial Sequence: Synthetic polynucleotide"
gaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaa

SEQ ID NO: 790 - protein, 122 aa, Artificial Sequence
  source: /note="Description of Artificial Sequence: Synthetic polypeptide"
EVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSS

SEQ ID NO: 791 - protein, 109 aa, Artificial Sequence
  source: /note="Description of Artificial Sequence: Synthetic polypeptide"
EIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIK

SEQ ID NO: 792 - protein, 490 aa, Artificial Sequence
  source: /note="Description of Artificial Sequence: Synthetic polypeptide"
MALPVTALLLPLALLLHAARPEVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKMGWSSGYLGAFDIWGQGTTVTVSSGGGGSGGGGSGGGGSEIVLTQSPGTLSLSPGERATLSCRASQSVASSFLAWYQQKPGQAPRLLIYGASGRATGIPDRFSGSGSGTDFTLTISRLEPEDFAVYYCQHYGGSPRLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 793 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaagtccaactggtggagtccgggggagggctcgtgcagcccggaggcagccttcggctgtcgtgcgccgcctccgggttcacgttctcatcctacgcgatgtcgtgggtcagacaggcaccaggaaagggactggaatgggtgtccgccattagcggctccggcggtagcacctactatgccgactcagtgaagggaaggttcactatctcccgcgacaacagcaagaacaccctgtacctccaaatgaactctctgcgggccgaggataccgcggtgtactattgcgccaagatgggttggtccagcggatacttgggagccttcgacatttggggacagggcactactgtgaccgtgtcctccgggggtggcggatcgggaggcggcggctcgggtggagggggttccgaaatcgtgttgacccagtcaccgggaaccctctcgctgtccccgggagaacgggctacactgtcatgtagagcgtcccagtccgtggcttcctcgttcctggcctggtaccagcagaagccgggacaggcaccccgcctgctcatctacggagccagcggccgggcgaccggcatccctgaccgcttctccggttccggctcgggcaccgactttactctgaccattagcaggcttgagcccgaggattttgccgtgtactactgccaacactacggggggagccctcgcctgaccttcggaggcggaactaaggtcgatatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 794 - protein, 121 aa, Artificial Sequence
  source: /note="Description of Artificial Sequence: Synthetic polypeptide"
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSS

SEQ ID NO: 795 - protein, 108 aa, Artificial Sequence
  source: /note="Description of Artificial Sequence: Synthetic polypeptide"
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKR

SEQ ID NO: 796 - protein, 451 aa, Artificial Sequence
  source: /note="Description of Artificial Sequence: Synthetic polypeptide"
  VARIANT (451)..(451): /replace=" "
  SITE (1)..(451): /note="Variant residues given in the sequence have no preference with respect to those in the annotations for variant positions"
QVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYNGYDVLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALAAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 797 - protein, 214 aa, Artificial Sequence
  source: /note="Description of Artificial Sequence: Synthetic polypeptide"
DIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 798 - protein, 119 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVAPYFAPFDYWGQGTLVTVSS

SEQ ID NO: 799 - protein, 109 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGNPPLYTFGQGTKVEIK

SEQ ID NO: 800 - protein, 449 aa, Artificial Sequence
  source: /note="Description of Artificial Sequence: Synthetic polypeptide"
  VARIANT (449)..(449): /replace=" "
  SITE (1)..(449): /note="Variant residues given in the sequence have no preference with respect to those in the annotations for variant positions"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVAPYFAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 801 - protein, 216 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGNPPLYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 802 - protein, 117 aa, Artificial Sequence
  source: /note="Description of Artificial Sequence: Synthetic polypeptide"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSS

SEQ ID NO: 803 - protein, 111 aa, Artificial Sequence
  source: /note="Description of Artificial Sequence: Synthetic polypeptide"
DIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIK

SEQ ID NO: 804 - protein, 447 aa, Artificial Sequence
  source: /note="Description of Artificial Sequence: Synthetic polypeptide"
  VARIANT (447)..(447): /replace=" "
  SITE (1)..(447): /note="Variant residues given in the sequence have no preference with respect to those in the annotations for variant positions"
QIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 805 - protein, 218 aa, Artificial Sequence
  source: /note="Description of Artificial Sequence: Synthetic polypeptide"
DIVLTQSPASLAMSLGKRATISCRASESVSVIGAHLIHWYQQKPGQPPKLLIYLASNLETGVPARFSGSGSGTDFTLTIDPVEEDDVAIYSCLQSRIFPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 806 - protein, 116 aa, Artificial Sequence
  source: /note="Description of Artificial Sequence: Synthetic polypeptide"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVLGWFDYWGQGTLVTVSS

SEQ ID NO: 807 - protein, 109 aa, Artificial Sequence
  source: /note="Description of Artificial Sequence: Synthetic polypeptide"
EIVLTQSPGTLSLSPGERATLSCRASQSVSSSYLAWYQQKPGQAPRLLIYGASSRATGIPDRFSGSGSGTDFTLTISRLEPEDFAVYYCQQYGYPPDFTFGQGTKVEIK

SEQ ID NO: 808 - protein, 477 aa, Artificial Sequence
  source: /note="Description of Artificial Sequence: Synthetic polypeptide"
  VARIANT (477)..(477): /replace=" "
  SITE (1)..(477): /note="Variant residues given in the sequence have no preference with respect to those in the annotations for variant positions"
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVLGWFDYWGQGTLVTVSSGGGGSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGYPPDFTFGQGTKVEIKGGGGSDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALAAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 809 - protein, 215 aa, Artificial Sequence
  source: /note="Description of Artificial Sequence: Synthetic polypeptide"
QAVVTQEPSLTVSPGGTVTLTCGSSTGAVTTSNYANWVQEKPGQAFRGLIGGTNKRAPGTPARFSGSLLGGKAALTLSGAQPEDEAEYYCALWYSNLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 810 - protein, 449 aa, Artificial Sequence
  source: /note="Description of Artificial Sequence: Synthetic polypeptide"
  VARIANT (449)..(449): /replace=" "
  SITE (1)..(449): /note="Variant residues given in the sequence have no preference with respect to those in the annotations for variant positions"
EVQLVESGGGLVKPGGSLRLSCAASGFTFSNSGMIWVRQAPGKGLEWVGHIRSKTDGGTTDYAAPVKGRFTISRDDSKNTLYLQMNSLKTEDTAVYYCTTGGSGSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 811 - protein, 253 aa, Artificial Sequence
  source: /note="Description of Artificial Sequence: Synthetic polypeptide"
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSGGGGSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 812 - protein, 127 aa, Artificial Sequence
  source: /note="Description of Artificial Sequence: Synthetic polypeptide"
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 813 - protein, 111 aa, Artificial Sequence
  source: /note="Description of Artificial Sequence: Synthetic polypeptide"
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 814 - protein, 12 aa, Artificial Sequence
  source: /note="Description of Artificial Sequence: Synthetic peptide"
GDSMLSNSDTWN

SEQ ID NO: 815 - protein, 7 aa, Artificial Sequence
  source: /note="Description of Artificial Sequence: Synthetic peptide"
SNSDTWN

SEQ ID NO: 816 - protein, 18 aa, Artificial Sequence
  source: /note="Description of Artificial Sequence: Synthetic peptide"
RTYHRSTWYDDYASSVRG

SEQ ID NO: 817 - protein, 15 aa, Artificial Sequence
  source: /note="Description of Artificial Sequence: Synthetic peptide"
VRLQDGNSWSDAFDV

SEQ ID NO: 818 - protein, 14 aa, Artificial Sequence
  source: /note="Description of Artificial Sequence: Synthetic peptide"
TGTSSDVGGYNYVS

SEQ ID NO: 819 - protein, 7 aa, Artificial Sequence
  source: /note="Description of Artificial Sequence: Synthetic peptide"
DVSNRPS

SEQ ID NO: 820 - protein, 11 aa, Artificial Sequence
  source: /note="Description of Artificial Sequence: Synthetic peptide"
SSYTSSSTLYV

SEQ ID NO: 821 - protein, 18 aa, Artificial Sequence
  source: /note="Description of Artificial Sequence: Synthetic peptide"
GSTSGSGKPGSGEGSTKG

SEQ ID NO: 822 - protein, 7 aa, Artificial Sequence
  source: /note="Description of Artificial Sequence: Synthetic peptide"
LAEAAAK

SEQ ID NO: 823 - DNA, 521 bp, Unknown
  source: /note="Description of Unknown: Wildtype PGK promoter"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccgcggcgacgcaaagggccttggtgcgggtctcgtcggcgcagggacgcgtttgggtcccgacggaaccttttccgcgttggggttggggcaccataagct

SEQ ID NO: 824 - DNA, 118 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtg

SEQ ID NO: 825 - DNA, 221 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacg

SEQ ID NO: 826 - DNA, 324 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccg

SEQ ID NO: 827 - DNA, 422 bp, Artificial Sequence
  source: /note="Description of Artificial Sequence: Synthetic polynucleotide"
acccctctctccagccactaagccagttgctccctcggctgacggctgcacgcgaggcctccgaacgtcttacgccttgtggcgcgcccgtccttgtcccgggtgtgatggcggggtgtggggcggagggcgtggcggggaagggccggcgacgagagccgcgcgggacgactcgtcggcgataaccggtgtcgggtagcgccagccgcgcgacggtaacgagggaccgcgacaggcagacgctcccatgatcactctgcacgccgaaggcaaatagtgcaggccgtgcggcgcttggcgttccttggaagggctgaatccccgcctcgtccttcgcagcggccccccgggtgttcccatcgccgcttctaggcccactgcgacgcttgcctgcacttcttacacgctctgggtcccagccg

SEQ ID NO: 828 - protein, 21 aa, Artificial Sequence
  source: /note="Description of Artificial Sequence: Synthetic peptide"
  VARIANT (1)..(3): /replace=" "
  SITE (1)..(21): /note="Variant residues given in the sequence have no preference with respect to those in the annotations for variant positions"
GSGEGRGSLLTCGDVEENPGP

SEQ ID NO: 829 - protein, 22 aa, Artificial Sequence
  source: /note="Description of Artificial Sequence: Synthetic peptide"
  VARIANT (1)..(3): /replace=" "
  SITE (1)..(22): /note="Variant residues given in the sequence have no preference with respect to those in the annotations for variant positions"
GSGATNFSLLKQAGDVEENPGP

SEQ ID NO: 830 - protein, 23 aa, Artificial Sequence
  source: /note="Description of Artificial Sequence: Synthetic peptide"
  VARIANT (1)..(3): /replace=" "
  SITE (1)..(23): /note="Variant residues given in the sequence have no preference with respect to those in the annotations for variant positions"
GSGQCTNYALLKLAGDVESNPGP

SEQ ID NO: 831 - protein, 25 aa, Artificial Sequence
  source: /note="Description of Artificial Sequence: Synthetic peptide"
  VARIANT (1)..(3): /replace=" "
  SITE (1)..(25): /note="Variant residues given in the sequence have no preference with respect to those in the annotations for variant positions"
GSGVKQTLNFDLLKLAGDVESNPGP

SEQ ID NO: 832 - DNA, 100 bp, Artificial Sequence
  source: /note="Description of Artificial Sequence: Synthetic polynucleotide"
tttttttttttttttttttttttttttttttttttttttttttttttttttttttttttttttttttttttttttttttttttttttttttttttttttt

SEQ ID NO: 833 - DNA, 5000 bp, Artificial Sequence
  source: /note="Description of Artificial Sequence: Synthetic polynucleotide"
  misc_feature (1)..(5000): /note="This sequence may encompass 50-5000 nucleotides"
  source: /note="See specification as filed for detailed description of substitutions and preferred embodiments"
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 834 - DNA, 5000 bp, Artificial Sequence; identical to SEQ ID NO: 174
  source: /note="Description of Artificial Sequence: Synthetic polynucleotide"
  misc_feature (1)..(5000): /note="This sequence may encompass 100-5000 nucleotides"
  source: /note="See specification as filed for detailed description of substitutions and preferred embodiments"

SEQ ID NO: 835 - DNA, 400 bp, Artificial Sequence
  source: /note="Description of Artificial Sequence: Synthetic polynucleotide"
  misc_feature (1)..(400): /note="This sequence may encompass 100-400 nucleotides"
  source: /note="See specification as filed for detailed description of substitutions and preferred embodiments"
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 836 - protein, 4 aa, Artificial Sequence
  source: /note="Description of Artificial Sequence: Synthetic peptide"
RGDS

SEQ ID NO: 837 - protein, 5 aa, Artificial Sequence
  source: /note="Description of Artificial Sequence: Synthetic peptide"
MALEK

SEQ ID NO: 838 - protein, 5 aa, Artificial Sequence
  source: /note="Description of Artificial Sequence: Synthetic peptide"
NYNLH

SEQ ID NO: 839 - protein, 17 aa, Artificial Sequence
  source: /note="Description of Artificial Sequence: Synthetic peptide"
AIYPGNYDTSYNQKFKG

SEQ ID NO: 840 - protein, 13 aa, Artificial Sequence
  source: /note="Description of Artificial Sequence: Synthetic peptide"
VDFGHSRYWYFDV

SEQ ID NO: 841 - protein, 7 aa, Artificial Sequence
  source: /note="Description of Artificial Sequence: Synthetic peptide"
GYTFTNY

SEQ ID NO: 842 - protein, 6 aa, Artificial Sequence
  source: /note="Description of Artificial Sequence: Synthetic peptide"
YPGNYD

SEQ ID NO: 843 - protein, 13 aa, Artificial Sequence
  source: /note="Description of Artificial Sequence: Synthetic peptide"
VDFGHSRYWYFDV

SEQ ID NO: 844 - protein, 8 aa, Artificial Sequence
  source: /note="Description of Artificial Sequence: Synthetic peptide"
GYTFTNYN

SEQ ID NO: 845 - protein, 8 aa, Artificial Sequence
  source: /note="Description of Artificial Sequence: Synthetic peptide"
IYPGNYDT

SEQ ID NO: 846 - protein, 15 aa, Artificial Sequence
  source: /note="Description of Artificial Sequence: Synthetic peptide"
ARVDFGHSRYWYFDV

SEQ ID NO: 847 - protein, 10 aa, Artificial Sequence
  source: /note="Description of Artificial Sequence: Synthetic peptide"
GYTFTNYNLH

SEQ ID NO: 848 - protein, 17 aa, Artificial Sequence
  source: /note="Description of Artificial Sequence: Synthetic peptide"
AIYPGNYDTSYNQKFKG

SEQ ID NO: 849 - protein, 13 aa, Artificial Sequence
  source: /note="Description of Artificial Sequence: Synthetic peptide"
VDFGHSRYWYFDV

SEQ ID NO: 850 - protein, 122 aa, Artificial Sequence
  source: /note="Description of Artificial Sequence: Synthetic polypeptide"
QVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSS

SEQ ID NO: 851 - DNA, 366 bp, Artificial Sequence
  source: /note="Description of Artificial Sequence: Synthetic polynucleotide"
caagtccaactcgtccagtccggtgcagaagtcaagaaacctggagcatccgtgaaagtgtcttgcaaagcctccggctacaccttcaccaactacaacctccattgggtcagacaggcccccggacaaggactcgaatggatgggagcgatctacccgggaaactacgacaccagctacaaccagaagttcaagggccgcgtgactatgaccgccgataagagcacctccaccgcctacatggaactgtcctcgctgaggtccgaggacactgcggtgtactactgcgcccgcgtggacttcggacactcacggtattggtacttcgacgtctggggacagggcactaccgtgaccgtgtcgagc

SEQ ID NO: 852 - protein, 10 aa, Artificial Sequence
  source: /note="Description of Artificial Sequence: Synthetic peptide"
RATSSVSSMN

SEQ ID NO: 853 - protein, 7 aa, Artificial Sequence
  source: /note="Description of Artificial Sequence: Synthetic peptide"
ATSNLAS

SEQ ID NO: 854 - protein, 9 aa, Artificial Sequence
  source: /note="Description of Artificial Sequence: Synthetic peptide"
QQWTFNPPT

SEQ ID NO: 855 - protein, 6 aa, Artificial Sequence
  source: /note="Description of Artificial Sequence: Synthetic peptide"
TSSVSS

SEQ ID NO: 856 - protein, 3 aa, Artificial Sequence
  source: /note="Description of Artificial Sequence: Synthetic peptide"
ATS

SEQ ID NO: 857 - protein, 6 aa, Artificial Sequence
  source: /note="Description of Artificial Sequence: Synthetic peptide"
WTFNPP

SEQ ID NO: 858 - protein, 5 aa, Artificial Sequence
  source: /note="Description of Artificial Sequence: Synthetic peptide"
SSVSS

SEQ ID NO: 859 - protein, 3 aa, Artificial Sequence
  source: /note="Description of Artificial Sequence: Synthetic peptide"
ATS

SEQ ID NO: 860 - protein, 9 aa, Artificial Sequence
  source: /note="Description of Artificial Sequence: Synthetic peptide"
QQWTFNPPT

SEQ ID NO: 861 - protein, 10 aa, Artificial Sequence
  source: /note="Description of Artificial Sequence: Synthetic peptide"
RATSSVSSMN

SEQ ID NO: 862 - protein, 7 aa, Artificial Sequence
  source: /note="Description of Artificial Sequence: Synthetic peptide"
ATSNLAS

SEQ ID NO: 863 - protein, 9 aa, Artificial Sequence
  source: /note="Description of Artificial Sequence: Synthetic peptide"
QQWTFNPPT

SEQ ID NO: 864 - protein, 106 aa, Artificial Sequence
  source: /note="Description of Artificial Sequence: Synthetic polypeptide"
DIQLTQSPSFLSASVGDRVTITCRATSSVSSMNWYQQKPGKAPKPLIHATSNLASGVPSRFSGSGSGTEYTLTISSLQPEDFATYYCQQWTFNPPTFGQGTKLEIK

SEQ ID NO: 865 - DNA, 318 bp, Artificial Sequence
  source: /note="Description of Artificial Sequence: Synthetic polynucleotide"
gatatccagctgactcagtccccgtcattcctgtccgcctccgtgggagacagagtgaccatcacctgtcgggccacttcctccgtgtcaagcatgaactggtatcagcagaagcccgggaaggccccaaagccgctgattcacgcgacgtccaacctggcttccggcgtgccgagccggttctccggctcggggagcgggactgagtacaccctgactatttcctcgcttcaacccgaggactttgctacctactactgccaacagtggaccttcaatcctccgacattcggacagggtaccaagttggaaatcaag

SEQ ID NO: 866 - protein, 20 aa, Artificial Sequence
  source: /note="Description of Artificial Sequence: Synthetic peptide"
GGGGSGGGGSGGGGSGGGGS

SEQ ID NO: 867 - protein, 248 aa, Artificial Sequence
  source: /note="Description of Artificial Sequence: Synthetic polypeptide"
QVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSSGGGGSGGGGSGGGGSGGGGSDIQLTQSPSFLSASVGDRVTITCRATSSVSSMNWYQQKPGKAPKPLIHATSNLASGVPSRFSGSGSGTEYTLTISSLQPEDFATYYCQQWTFNPPTFGQGTKLEIK

SEQ ID NO: 868 - DNA, 744 bp, Artificial Sequence
  source: /note="Description of Artificial Sequence: Synthetic polynucleotide"
caagtccaactcgtccagtccggtgcagaagtcaagaaacctggagcatccgtgaaagtgtcttgcaaagcctccggctacaccttcaccaactacaacctccattgggtcagacaggcccccggacaaggactcgaatggatgggagcgatctacccgggaaactacgacaccagctacaaccagaagttcaagggccgcgtgactatgaccgccgataagagcacctccaccgcctacatggaactgtcctcgctgaggtccgaggacactgcggtgtactactgcgcccgcgtggacttcggacactcacggtattggtacttcgacgtctggggacagggcactaccgtgaccgtgtcgagcggcggaggaggttcgggagggggcggatcagggggcggcggcagcggtggagggggctcggatatccagctgactcagtccccgtcattcctgtccgcctccgtgggagacagagtgaccatcacctgtcgggccacttcctccgtgtcaagcatgaactggtatcagcagaagcccgggaaggccccaaagccgctgattcacgcgacgtccaacctggcttccggcgtgccgagccggttctccggctcggggagcgggactgagtacaccctgactatttcctcgcttcaacccgaggactttgctacctactactgccaacagtggaccttcaatcctccgacattcggacagggtaccaagttggaaatcaag

SEQ ID NO: 869 - protein, 492 aa, Artificial Sequence
  source: /note="Description of Artificial Sequence: Synthetic polypeptide"
MALPVTALLLPLALLLHAARPQVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSSGGGGSGGGGSGGGGSGGGGSDIQLTQSPSFLSASVGDRVTITCRATSSVSSMNWYQQKPGKAPKPLIHATSNLASGVPSRFSGSGSGTEYTLTISSLQPEDFATYYCQQWTFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 870 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggtgcagaagtcaagaaacctggagcatccgtgaaagtgtcttgcaaagcctccggctacaccttcaccaactacaacctccattgggtcagacaggcccccggacaaggactcgaatggatgggagcgatctacccgggaaactacgacaccagctacaaccagaagttcaagggccgcgtgactatgaccgccgataagagcacctccaccgcctacatggaactgtcctcgctgaggtccgaggacactgcggtgtactactgcgcccgcgtggacttcggacactcacggtattggtacttcgacgtctggggacagggcactaccgtgaccgtgtcgagcggcggaggaggttcgggagggggcggatcagggggcggcggcagcggtggagggggctcggatatccagctgactcagtccccgtcattcctgtccgcctccgtgggagacagagtgaccatcacctgtcgggccacttcctccgtgtcaagcatgaactggtatcagcagaagcccgggaaggccccaaagccgctgattcacgcgacgtccaacctggcttccggcgtgccgagccggttctccggctcggggagcgggactgagtacaccctgactatttcctcgcttcaacccgaggactttgctacctactactgccaacagtggaccttcaatcctccgacattcggacagggtaccaagttggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 871 - protein, 5 aa, Artificial Sequence
  source: /note="Description of Artificial Sequence: Synthetic peptide"
SYNMH

SEQ ID NO: 872 - protein, 17 aa, Artificial Sequence
  source: /note="Description of Artificial Sequence: Synthetic peptide"
AIYPGNGDTSYNPKFKG

SEQ ID NO: 873 - protein, 13 aa, Artificial Sequence
  source: /note="Description of Artificial Sequence: Synthetic peptide"
SYFYGSSSWYFDV

SEQ ID NO: 874 - protein, 7 aa, Artificial Sequence
  source: /note="Description of Artificial Sequence: Synthetic peptide"
GYTFTSY

SEQ ID NO: 875 - protein, 6 aa, Artificial Sequence
  source: /note="Description of Artificial Sequence: Synthetic peptide"
YPGNGD

SEQ ID NO: 876 - protein, 13 aa, Artificial Sequence
  source: /note="Description of Artificial Sequence: Synthetic peptide"
SYFYGSSSWYFDV

SEQ ID NO: 877 - protein, 8 aa, Artificial Sequence
  source: /note="Description of Artificial Sequence: Synthetic peptide"
GYTFTSYN

SEQ ID NO: 878 - protein, 8 aa, Artificial Sequence
  source: /note="Description of Artificial Sequence: Synthetic peptide"
IYPGNGDT

SEQ ID NO: 879 - protein, 15 aa, Artificial Sequence
  source: /note="Description of Artificial Sequence: Synthetic peptide"
ARSYFYGSSSWYFDV

SEQ ID NO: 880 - protein, 10 aa, Artificial Sequence
  source: /note="Description of Artificial Sequence: Synthetic peptide"
GYTFTSYNMH

SEQ ID NO: 881 - protein, 17 aa, Artificial Sequence
  source: /note="Description of Artificial Sequence: Synthetic peptide"
AIYPGNGDTSYNPKFKG

SEQ ID NO: 882 - protein, 13 aa, Artificial Sequence
  source: /note="Description of Artificial Sequence: Synthetic peptide"
SYFYGSSSWYFDV

SEQ ID NO: 883 - protein, 122 aa, Artificial Sequence
  source: /note="Description of Artificial Sequence: Synthetic polypeptide"
QVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSS

SEQ ID NO: 884 - DNA, 366 bp, Artificial Sequence
  source: /note="Description of Artificial Sequence: Synthetic polynucleotide"
caagtgcagctcgtccagtccggtgcagaagtcaagaaacccggtgcttcagtgaaagtgtcctgcaaggcctccggttacaccttcacctcctacaacatgcactgggtccgccaagccccgggccagggactcgaatggatgggagccatctaccctggcaacggggacacctcatacaaccctaagttcaagggcagagtgaccatgactgcggacaagtccactagaacagcgtacatggagctgagcagcctgcggtccgaggatactgccgtgtactactgcgcccgctcctacttctacggaagctcgtcgtggtacttcgatgtctggggacagggcaccactgtgactgtgtcctcc

SEQ ID NO: 885 - protein, 10 aa, Artificial Sequence
  source: /note="Description of Artificial Sequence: Synthetic peptide"
RASSSVSSMH

SEQ ID NO: 886 - protein, 7 aa, Artificial Sequence
  source: /note="Description of Artificial Sequence: Synthetic peptide"
ATSNLAS

SEQ ID NO: 887 - protein, 9 aa, Artificial Sequence
  source: /note="Description of Artificial Sequence: Synthetic peptide"
QQWIFNPPT

SEQ ID NO: 888 - protein, 6 aa, Artificial Sequence
  source: /note="Description of Artificial Sequence: Synthetic peptide"
SSSVSS

SEQ ID NO: 889 - protein, 3 aa, Artificial Sequence
  source: /note="Description of Artificial Sequence: Synthetic peptide"
ATS

SEQ ID NO: 890 - protein, 6 aa, Artificial Sequence
  source: /note="Description of Artificial Sequence: Synthetic peptide"
WIFNPP

SEQ ID NO: 891 - protein, 5 aa, Artificial Sequence
  source: /note="Description of Artificial Sequence: Synthetic peptide"
SSVSS

SEQ ID NO: 892 - protein, 3 aa, Artificial Sequence
  source: /note="Description of Artificial Sequence: Synthetic peptide"
ATS

SEQ ID NO: 893 - protein, 9 aa, Artificial Sequence
  source: /note="Description of Artificial Sequence: Synthetic peptide"
QQWIFNPPT

SEQ ID NO: 894 - protein, 10 aa, Artificial Sequence
  source: /note="Description of Artificial Sequence: Synthetic peptide"
RASSSVSSMH

SEQ ID NO: 895 - protein, 7 aa, Artificial Sequence
  source: /note="Description of Artificial Sequence: Synthetic peptide"
ATSNLAS

SEQ ID NO: 896 - protein, 9 aa, Artificial Sequence
  source: /note="Description of Artificial Sequence: Synthetic peptide"
QQWIFNPPT

SEQ ID NO: 897 - protein, 106 aa, Artificial Sequence
  source: /note="Description of Artificial Sequence: Synthetic polypeptide"
EIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK

SEQ ID NO: 898 - DNA, 318 bp, Artificial Sequence
  source: /note="Description of Artificial Sequence: Synthetic polynucleotide"
gaaattgtgctgactcagagccccgccaccctgagcttgtcccccggggaaagggcaacgctgtcatgccgcgcctcgtcatccgtgtcctccatgcattggtaccagcagaagccgggacaggcccctcggccgctgatcttcgccacctccaatctcgcttccggcattccggcccggttctcgggaagcgggtcggggaccgactataccctgaccatctctagccttgaacctgaggacgccgcggtgtactattgtcaacagtggatctttaaccccccaaccttcggtggaggcaccaaagtggagattaag

SEQ ID NO: 899 - protein, 20 aa, Artificial Sequence
  source: /note="Description of Artificial Sequence: Synthetic peptide"
GGGGSGGGGSGGGGSGGGGS

SEQ ID NO: 900 - protein, 248 aa, Artificial Sequence
  source: /note="Description of Artificial Sequence: Synthetic polypeptide"
QVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK

SEQ ID NO: 901 - DNA, 744 bp, Artificial Sequence
  source: /note="Description of Artificial Sequence: Synthetic polynucleotide"
caagtgcagctcgtccagtccggtgcagaagtcaagaaacccggtgcttcagtgaaagtgtcctgcaaggcctccggttacaccttcacctcctacaacatgcactgggtccgccaagccccgggccagggactcgaatggatgggagccatctaccctggcaacggggacacctcatacaaccctaagttcaagggcagagtgaccatgactgcggacaagtccactagaacagcgtacatggagctgagcagcctgcggtccgaggatactgccgtgtactactgcgcccgctcctacttctacggaagctcgtcgtggtacttcgatgtctggggacagggcaccactgtgactgtgtcctccggtggcggaggctcgggcggaggcggaagcggcggcgggggatcgggaggaggagggtccgaaattgtgctgactcagagccccgccaccctgagcttgtcccccggggaaagggcaacgctgtcatgccgcgcctcgtcatccgtgtcctccatgcattggtaccagcagaagccgggacaggcccctcggccgctgatcttcgccacctccaatctcgcttccggcattccggcccggttctcgggaagcgggtcggggaccgactataccctgaccatctctagccttgaacctgaggacgccgcggtgtactattgtcaacagtggatctttaaccccccaaccttcggtggaggcaccaaagtggagattaag

SEQ ID NO: 902 - protein, 492 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 903 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcagctcgtccagtccggtgcagaagtcaagaaacccggtgcttcagtgaaagtgtcctgcaaggcctccggttacaccttcacctcctacaacatgcactgggtccgccaagccccgggccagggactcgaatggatgggagccatctaccctggcaacggggacacctcatacaaccctaagttcaagggcagagtgaccatgactgcggacaagtccactagaacagcgtacatggagctgagcagcctgcggtccgaggatactgccgtgtactactgcgcccgctcctacttctacggaagctcgtcgtggtacttcgatgtctggggacagggcaccactgtgactgtgtcctccggtggcggaggctcgggcggaggcggaagcggcggcgggggatcgggaggaggagggtccgaaattgtgctgactcagagccccgccaccctgagcttgtcccccggggaaagggcaacgctgtcatgccgcgcctcgtcatccgtgtcctccatgcattggtaccagcagaagccgggacaggcccctcggccgctgatcttcgccacctccaatctcgcttccggcattccggcccggttctcgggaagcgggtcggggaccgactataccctgaccatctctagccttgaacctgaggacgccgcggtgtactattgtcaacagtggatctttaaccccccaaccttcggtggaggcaccaaagtggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 904 - protein, 5 aa, Artificial Sequence
  source: /note="Description of Artificial Sequence: Synthetic peptide"
NYWMH

SEQ ID NO: 905 - protein, 17 aa, Artificial Sequence
  source: /note="Description of Artificial Sequence: Synthetic peptide"
FITPTTGYPEYNQKFKD

SEQ ID NO: 906 - protein, 13 aa, Artificial Sequence
  source: /note="Description of Artificial Sequence: Synthetic peptide"
RKVGKGVYYALDY

SEQ ID NO: 907 - protein, 7 aa, Artificial Sequence
  source: /note="Description of Artificial Sequence: Synthetic peptide"
GYTFTNY

SEQ ID NO: 908 - protein, 6 aa, Artificial Sequence
  source: /note="Description of Artificial Sequence: Synthetic peptide"
TPTTGY

SEQ ID NO: 909 - protein, 13 aa, Artificial Sequence
  source: /note="Description of Artificial Sequence: Synthetic peptide"
RKVGKGVYYALDY

SEQ ID NO: 910 - protein, 8 aa, Artificial Sequence
  source: /note="Description of Artificial Sequence: Synthetic peptide"
GYTFTNYW

SEQ ID NO: 911 - protein, 8 aa, Artificial Sequence
  source: /note="Description of Artificial Sequence: Synthetic peptide"
ITPTTGYP

SEQ ID NO: 912 - protein, 15 aa, Artificial Sequence
  source: /note="Description of Artificial Sequence: Synthetic peptide"
ARRKVGKGVYYALDY

SEQ ID NO: 913 - protein, 10 aa, Artificial Sequence
  source: /note="Description of Artificial Sequence: Synthetic peptide"
GYTFTNYWMH

SEQ ID NO: 914 - protein, 17 aa, Artificial Sequence
  source: /note="Description of Artificial Sequence: Synthetic peptide"
FITPTTGYPEYNQKFKD

SEQ ID NO: 915 - protein, 13 aa, Artificial Sequence
  source: /note="Description of Artificial Sequence: Synthetic peptide"
RKVGKGVYYALDY

SEQ ID NO: 916 - protein, 122 aa, Artificial Sequence
  source: /note="Description of Artificial Sequence: Synthetic polypeptide"
QVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSS

SEQ ID NO: 917 - DNA, 366 bp, Artificial Sequence
  source: /note="Description of Artificial Sequence: Synthetic polynucleotide"
caagtgcaactcgtccagtccggtgcagaagtcaagaaaccaggcgcatccgtgaaagtctcctgcaaagcctccggctacacattcactaactattggatgcattgggtgcgccaggccccgggacaggggctggagtggatggggttcattacccctaccaccggctaccctgagtacaaccagaagttcaaggatagggtcaccatgaccgctgacaagtccacctccaccgcgtacatggaactgtcatcgctccggtccgaggataccgcggtgtactactgcgcccggagaaaagtcggaaagggagtgtattacgccttggactactggggacaggggactaccgtgaccgtgtcgagc

SEQ ID NO: 918 - protein, 11 aa, Artificial Sequence
  source: /note="Description of Artificial Sequence: Synthetic peptide"
RASGNIHNYLA

SEQ ID NO: 919 - protein, 7 aa, Artificial Sequence
  source: /note="Description of Artificial Sequence: Synthetic peptide"
NTKTLAD

SEQ ID NO: 920 - protein, 9 aa, Artificial Sequence
  source: /note="Description of Artificial Sequence: Synthetic peptide"
QHFWSSPWT

SEQ ID NO: 921 - protein, 7 aa, Artificial Sequence
  source: /note="Description of Artificial Sequence: Synthetic peptide"
SGNIHNY

SEQ ID NO: 922 - protein, 3 aa, Artificial Sequence
  source: /note="Description of Artificial Sequence: Synthetic peptide"
NTK

SEQ ID NO: 923 - protein, 6 aa, Artificial Sequence
  source: /note="Description of Artificial Sequence: Synthetic peptide"
FWSSPW

SEQ ID NO: 924 - protein, 6 aa, Artificial Sequence
  source: /note="Description of Artificial Sequence: Synthetic peptide"
GNIHNY

SEQ ID NO: 925 - protein, 3 aa, Artificial Sequence
  source: /note="Description of Artificial Sequence: Synthetic peptide"
NTK

SEQ ID NO: 926 - protein, 9 aa, Artificial Sequence
  source: /note="Description of Artificial Sequence: Synthetic peptide"
QHFWSSPWT

SEQ ID NO: 927 - protein, 11 aa, Artificial Sequence
  source: /note="Description of Artificial Sequence: Synthetic peptide"
RASGNIHNYLA

SEQ ID NO: 928 - protein, 7 aa, Artificial Sequence
  source: /note="Description of Artificial Sequence: Synthetic peptide"
NTKTLAD

SEQ ID NO: 929 - protein, 9 aa, Artificial Sequence
  source: /note="Description of Artificial Sequence: Synthetic peptide"
QHFWSSPWT

SEQ ID NO: 930 - protein, 107 aa, Artificial Sequence
  source: /note="Description of Artificial Sequence: Synthetic polypeptide"
DIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIK

SEQ ID NO: 931 - DNA, 321 bp, Artificial Sequence
  source: /note="Description of Artificial Sequence: Synthetic polynucleotide"
gacatccagatgacccagtccccgtcaagccttagcgcctccgtgggcgaccgcgtgaccattacttgtcgggcgtcgggaaacatccacaactacctcgcctggtaccagcagaagccgggaaaggtccccaagctgctgatctacaataccaagactctggccgacggagtgccttcccgcttttccggttcgggaagcgggactgactacaccctgactatctcctcgctgcaacccgaagatgtggctacgtactactgccagcacttctggtcctctccctggaccttcggcggtggcactaaggtcgagattaag

SEQ ID NO: 932 - protein, 20 aa, Artificial Sequence
  source: /note="Description of Artificial Sequence: Synthetic peptide"
GGGGSGGGGSGGGGSGGGGS

SEQ ID NO: 933 - protein, 249 aa, Artificial Sequence
  source: /note="Description of Artificial Sequence: Synthetic polypeptide"
QVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSSGGGGSGGGGSGGGGSGGGGSDIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIK

SEQ ID NO: 934 - DNA, 747 bp, Artificial Sequence
  source: /note="Description of Artificial Sequence: Synthetic polynucleotide"
caagtgcaactcgtccagtccggtgcagaagtcaagaaaccaggcgcatccgtgaaagtctcctgcaaagcctccggctacacattcactaactattggatgcattgggtgcgccaggccccgggacaggggctggagtggatggggttcattacccctaccaccggctaccctgagtacaaccagaagttcaaggatagggtcaccatgaccgctgacaagtccacctccaccgcgtacatggaactgtcatcgctccggtccgaggataccgcggtgtactactgcgcccggagaaaagtcggaaagggagtgtattacgccttggactactggggacaggggactaccgtgaccgtgtcgagcggtggaggcggctccggcggaggaggaagcgggggaggcggttcagggggcggaggaagcgacatccagatgacccagtccccgtcaagccttagcgcctccgtgggcgaccgcgtgaccattacttgtcgggcgtcgggaaacatccacaactacctcgcctggtaccagcagaagccgggaaaggtccccaagctgctgatctacaataccaagactctggccgacggagtgccttcccgcttttccggttcgggaagcgggactgactacaccctgactatctcctcgctgcaacccgaagatgtggctacgtactactgccagcacttctggtcctctccctggaccttcggcggtggcactaaggtcgagattaag

SEQ ID NO: 935 - protein, 493 aa, Artificial Sequence
  source: /note="Description of Artificial Sequence: Synthetic polypeptide"
MALPVTALLLPLALLLHAARPQVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSSGGGGSGGGGSGGGGSGGGGSDIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 936 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtccagtccggtgcagaagtcaagaaaccaggcgcatccgtgaaagtctcctgcaaagcctccggctacacattcactaactattggatgcattgggtgcgccaggccccgggacaggggctggagtggatggggttcattacccctaccaccggctaccctgagtacaaccagaagttcaaggatagggtcaccatgaccgctgacaagtccacctccaccgcgtacatggaactgtcatcgctccggtccgaggataccgcggtgtactactgcgcccggagaaaagtcggaaagggagtgtattacgccttggactactggggacaggggactaccgtgaccgtgtcgagcggtggaggcggctccggcggaggaggaagcgggggaggcggttcagggggcggaggaagcgacatccagatgacccagtccccgtcaagccttagcgcctccgtgggcgaccgcgtgaccattacttgtcgggcgtcgggaaacatccacaactacctcgcctggtaccagcagaagccgggaaaggtccccaagctgctgatctacaataccaagactctggccgacggagtgccttcccgcttttccggttcgggaagcgggactgactacaccctgactatctcctcgctgcaacccgaagatgtggctacgtactactgccagcacttctggtcctctccctggaccttcggcggtggcactaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 937 - protein, 5 aa, Artificial Sequence
  source: /note="Description of Artificial Sequence: Synthetic peptide"
NYWMH

SEQ ID NO: 938 - protein, 17 aa, Artificial Sequence
  source: /note="Description of Artificial Sequence: Synthetic peptide"
FITPTTGYPEYNQKFKD

SEQ ID NO: 939 - protein, 13 aa, Artificial Sequence
  source: /note="Description of Artificial Sequence: Synthetic peptide"
RKVGKGVYYALDY

SEQ ID NO: 940 - protein, 7 aa, Artificial Sequence
  source: /note="Description of Artificial Sequence: Synthetic peptide"
GYTFTNY

SEQ ID NO: 941 - protein, 6 aa, Artificial Sequence
  source: /note="Description of Artificial Sequence: Synthetic peptide"
TPTTGY

SEQ ID NO: 942 - protein, 13 aa, Artificial Sequence
  source: /note="Description of Artificial Sequence: Synthetic peptide"
RKVGKGVYYALDY

SEQ ID NO: 943 - protein, 8 aa, Artificial Sequence
  source: /note="Description of Artificial Sequence: Synthetic peptide"
GYTFTNYW

SEQ ID NO: 944 - protein, 8 aa, Artificial Sequence
  source: /note="Description of Artificial Sequence: Synthetic peptide"
ITPTTGYP

SEQ ID NO: 945 - protein, 15 aa, Artificial Sequence
  source: /note="Description of Artificial Sequence: Synthetic peptide"
ARRKVGKGVYYALDY

SEQ ID NO: 946 - protein, 10 aa, Artificial Sequence
  source: /note="Description of Artificial Sequence: Synthetic peptide"
GYTFTNYWMH

SEQ ID NO: 947 - protein, 17 aa, Artificial Sequence
  source: /note="Description of Artificial Sequence: Synthetic peptide"
FITPTTGYPEYNQKFKD

SEQ ID NO: 948 - protein, 13 aa, Artificial Sequence
  source: /note="Description of Artificial Sequence: Synthetic peptide"
RKVGKGVYYALDY

SEQ ID NO: 949 - protein, 122 aa, Artificial Sequence
  source: /note="Description of Artificial Sequence: Synthetic polypeptide"
QVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSS

SEQ ID NO: 950 - DNA, 366 bp, Artificial Sequence
  source: /note="Description of Artificial Sequence: Synthetic polynucleotide"
caagtccaactcgtccaatcaggagcagaagtcaagaagcccggaagctctgtcaaagtgtcctgcaaggcctccggttacaccttcaccaactattggatgcactgggtcagacaggccccgggacagggcttggaatggatgggtttcatcactccaaccaccggttacccggagtacaaccagaagtttaaggaccgcgtgaccattactgccgacaagtccacgagcaccgcttacatggaacttagcagcctgcggtccgaggacactgccgtgtattactgcgcgcggaggaaggtcggaaagggagtgtactacgcactggactactggggccagggaaccaccgtgactgtgtcctcc

SEQ ID NO: 951 - protein, 11 aa, Artificial Sequence
  source: /note="Description of Artificial Sequence: Synthetic peptide"
RASGNIHNYLA

SEQ ID NO: 952 - protein, 7 aa, Artificial Sequence
  source: /note="Description of Artificial Sequence: Synthetic peptide"
NTKTLAD

SEQ ID NO: 953 - protein, 9 aa, Artificial Sequence
  source: /note="Description of Artificial Sequence: Synthetic peptide"
QHFWSSPWT

SEQ ID NO: 954 - protein, 7 aa, Artificial Sequence
  source: /note="Description of Artificial Sequence: Synthetic peptide"
SGNIHNY

SEQ ID NO: 955 - protein, 3 aa, Artificial Sequence
  source: /note="Description of Artificial Sequence: Synthetic peptide"
NTK

SEQ ID NO: 956 - protein, 6 aa, Artificial Sequence
  source: /note="Description of Artificial Sequence: Synthetic peptide"
FWSSPW

SEQ ID NO: 957 - protein, 6 aa, Artificial Sequence
  source: /note="Description of Artificial Sequence: Synthetic peptide"
GNIHNY

SEQ ID NO: 958 - protein, 3 aa, Artificial Sequence
  source: /note="Description of Artificial Sequence: Synthetic peptide"
NTK

SEQ ID NO: 959 - protein, 9 aa, Artificial Sequence
  source: /note="Description of Artificial Sequence: Synthetic peptide"
QHFWSSPWT

SEQ ID NO: 960 - protein, 11 aa, Artificial Sequence
  source: /note="Description of Artificial Sequence: Synthetic peptide"
RASGNIHNYLA

SEQ ID NO: 961 - protein, 7 aa, Artificial Sequence
  source: /note="Description of Artificial Sequence: Synthetic peptide"
NTKTLAD

SEQ ID NO: 962 - protein, 9 aa, Artificial Sequence
  source: /note="Description of Artificial Sequence: Synthetic peptide"
QHFWSSPWT

SEQ ID NO: 963 - protein, 107 aa, Artificial Sequence; identical to SEQ ID NO: 930
  source: /note="Description of Artificial Sequence: Synthetic polypeptide"

SEQ ID NO: 964 - DNA, 321 bp, Artificial Sequence
  source: /note="Description of Artificial Sequence: Synthetic polynucleotide"
gatattcagatgacccagtccccttcatccctgagcgcctcagtgggcgatagagtgaccatcacttgtcgcgcctcgggcaatatccacaactacctcgcctggtaccagcagaagccgggaaaagtgcctaagctgctgatctacaacactaagaccctggcggatggagtgcccagccggttctccggctccggcagcggcacagactacaccctcaccatctcctcgctgcaaccagaggacgtggctacctactactgccagcatttctggtcgtccccctggactttcggaggggggaccaaagtggagattaag

SEQ ID NO: 965 - protein, 20 aa, Artificial Sequence
  source: /note="Description of Artificial Sequence: Synthetic peptide"
GGGGSGGGGSGGGGSGGGGS

SEQ ID NO: 966 - protein, 249 aa, Artificial Sequence
  source: /note="Description of Artificial Sequence: Synthetic polypeptide"
QVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSSGGGGSGGGGSGGGGSGGGGSDIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIK

SEQ ID NO: 967 - DNA, 747 bp, Artificial Sequence
  source: /note="Description of Artificial Sequence: Synthetic polynucleotide"
caagtccaactcgtccaatcaggagcagaagtcaagaagcccggaagctctgtcaaagtgtcctgcaaggcctccggttacaccttcaccaactattggatgcactgggtcagacaggccccgggacagggcttggaatggatgggtttcatcactccaaccaccggttacccggagtacaaccagaagtttaaggaccgcgtgaccattactgccgacaagtccacgagcaccgcttacatggaacttagcagcctgcggtccgaggacactgccgtgtattactgcgcgcggaggaaggtcggaaagggagtgtactacgcactggactactggggccagggaaccaccgtgactgtgtcctccggtggcggagggtcgggaggggggggctcgggaggaggagggtccgggggcggtggctcagatattcagatgacccagtccccttcatccctgagcgcctcagtgggcgatagagtgaccatcacttgtcgcgcctcgggcaatatccacaactacctcgcctggtaccagcagaagccgggaaaagtgcctaagctgctgatctacaacactaagaccctggcggatggagtgcccagccggttctccggctccggcagcggcacagactacaccctcaccatctcctcgctgcaaccagaggacgtggctacctactactgccagcatttctggtcgtccccctggactttcggaggggggaccaaagtggagattaag

SEQ ID NO: 968 - protein, 493 aa, Artificial Sequence
  source: /note="Description of Artificial Sequence: Synthetic polypeptide"
MALPVTALLLPLALLLHAARPQVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSSGGGGSGGGGSGGGGSGGGGSDIQMTQSPSSLSASVGDRVTITCRASGNIHNYLAWYQQKPGKVPKLLIYNTKTLADGVPSRFSGSGSGTDYTLTISSLQPEDVATYYCQHFWSSPWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 969 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccaatcaggagcagaagtcaagaagcccggaagctctgtcaaagtgtcctgcaaggcctccggttacaccttcaccaactattggatgcactgggtcagacaggccccgggacagggcttggaatggatgggtttcatcactccaaccaccggttacccggagtacaaccagaagtttaaggaccgcgtgaccattactgccgacaagtccacgagcaccgcttacatggaacttagcagcctgcggtccgaggacactgccgtgtattactgcgcgcggaggaaggtcggaaagggagtgtactacgcactggactactggggccagggaaccaccgtgactgtgtcctccggtggcggagggtcgggaggggggggctcgggaggaggagggtccgggggcggtggctcagatattcagatgacccagtccccttcatccctgagcgcctcagtgggcgatagagtgaccatcacttgtcgcgcctcgggcaatatccacaactacctcgcctggtaccagcagaagccgggaaaagtgcctaagctgctgatctacaacactaagaccctggcggatggagtgcccagccggttctccggctccggcagcggcacagactacaccctcaccatctcctcgctgcaaccagaggacgtggctacctactactgccagcatttctggtcgtccccctggactttcggaggggggaccaaagtggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 970 - protein, 5 aa, Artificial Sequence
  source: /note="Description of Artificial Sequence: Synthetic peptide"
NYWMH

SEQ ID NO: 971 - protein, 17 aa, Artificial Sequence
  source: /note="Description of Artificial Sequence: Synthetic peptide"
FITPTTGYPEYNQKFKD

SEQ ID NO: 972 - protein, 13 aa, Artificial Sequence
  source: /note="Description of Artificial Sequence: Synthetic peptide"
RKVGKGVYYALDY

SEQ ID NO: 973 - protein, 7 aa, Artificial Sequence
  source: /note="Description of Artificial Sequence: Synthetic peptide"
GYTFTNY

SEQ ID NO: 974 - protein, 6 aa, Artificial Sequence
  source: /note="Description of Artificial Sequence: Synthetic peptide"
TPTTGY

SEQ ID NO: 975 - protein, 13 aa, Artificial Sequence
  source: /note="Description of Artificial Sequence: Synthetic peptide"
RKVGKGVYYALDY

SEQ ID NO: 976 - protein, 8 aa, Artificial Sequence
  source: /note="Description of Artificial Sequence: Synthetic peptide"
GYTFTNYW

SEQ ID NO: 977 - protein, 8 aa, Artificial Sequence
  source: /note="Description of Artificial Sequence: Synthetic peptide"
ITPTTGYP

SEQ ID NO: 978 - protein, 15 aa, Artificial Sequence
  source: /note="Description of Artificial Sequence: Synthetic peptide"
ARRKVGKGVYYALDY

SEQ ID NO: 979 - protein, 10 aa, Artificial Sequence
  source: /note="Description of Artificial Sequence: Synthetic peptide"
GYTFTNYWMH

SEQ ID NO: 980 - protein, 17 aa, Artificial Sequence
  source: /note="Description of Artificial Sequence: Synthetic peptide"
FITPTTGYPEYNQKFKD

SEQ ID NO: 981 - protein, 13 aa, Artificial Sequence
  source: /note="Description of Artificial Sequence: Synthetic peptide"
RKVGKGVYYALDY

SEQ ID NO: 982 - protein, 122 aa, Artificial Sequence; identical to SEQ ID NO: 916
  source: /note="Description of Artificial Sequence: Synthetic polypeptide"

SEQ ID NO: 983 - DNA, 366 bp, Artificial Sequence
  source: /note="Description of Artificial Sequence: Synthetic polynucleotide"
caagtccaactcgtccagtccggtgcagaagtcaagaaacccggagcttccgtgaaagtgtcctgcaaagcctccggttacacctttacgaactactggatgcattgggtgcgccaggccccgggacaggggctggaatggatgggcttcattacccccaccaccggataccccgagtacaatcagaagttcaaggaccgggtcaccatgaccgccgacaagtcaacctctactgcttacatggagctgtccagcctgcggtcggaagataccgccgtgtattactgcgcgagaaggaaagtcggaaagggagtgtactatgccctggactactggggacaggggaccactgtgactgtgtcaagc

SEQ ID NO: 984 - protein, 11 aa, Artificial Sequence
  source: /note="Description of Artificial Sequence: Synthetic peptide"
RASGNIHNYLA

SEQ ID NO: 985 - protein, 7 aa, Artificial Sequence
  source: /note="Description of Artificial Sequence: Synthetic peptide"
NTKTLAD

SEQ ID NO: 986 - protein, 9 aa, Artificial Sequence
  source: /note="Description of Artificial Sequence: Synthetic peptide"
QHFWSSPWT

SEQ ID NO: 987 - protein, 7 aa, Artificial Sequence
  source: /note="Description of Artificial Sequence: Synthetic peptide"
SGNIHNY

SEQ ID NO: 988 - protein, 3 aa, Artificial Sequence
  source: /note="Description of Artificial Sequence: Synthetic peptide"
NTK

SEQ ID NO: 989 - protein, 6 aa, Artificial Sequence
  source: /note="Description of Artificial Sequence: Synthetic peptide"
FWSSPW

SEQ ID NO: 990 - protein, 6 aa, Artificial Sequence
  source: /note="Description of Artificial Sequence: Synthetic peptide"
GNIHNY

SEQ ID NO: 991 - protein, 3 aa, Artificial Sequence
  source: /note="Description of Artificial Sequence: Synthetic peptide"
NTK

SEQ ID NO: 992 - protein, 9 aa, Artificial Sequence
  source: /note="Description of Artificial Sequence: Synthetic peptide"
QHFWSSPWT

SEQ ID NO: 993 - protein, 11 aa, Artificial Sequence
  source: /note="Description of Artificial Sequence: Synthetic peptide"
RASGNIHNYLA

SEQ ID NO: 994 - protein, 7 aa, Artificial Sequence
  source: /note="Description of Artificial Sequence: Synthetic peptide"
NTKTLAD

SEQ ID NO: 995 - protein, 9 aa, Artificial Sequence
  source: /note="Description of Artificial Sequence: Synthetic peptide"
QHFWSSPWT

SEQ ID NO: 996 - protein, 107 aa, Artificial Sequence
  source: /note="Description of Artificial Sequence: Synthetic polypeptide"
AIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIK

SEQ ID NO: 997 - DNA, 321 bp, Artificial Sequence
  source: /note="Description of Artificial Sequence: Synthetic polynucleotide"
gcgatccgcatgacccagagcccgttctccctgtccgcgtccgtgggggaccgcgtgactatcacgtgtcgggcctccgggaacatccacaactacctcgcatggtaccagcagaagccggccaaggcccctaagttgttcatctacaacaccaagactcttgccgacggagtgccgtcccggtttagcggaagcggttccggcaccgactacaccctgactatctcgagcctgcaaccagaagatttcgccacttactactgccagcacttctggtcgtccccttggacattcggcggcggcaccaaggtcgagattaag

SEQ ID NO: 998 - protein, 20 aa, Artificial Sequence
  source: /note="Description of Artificial Sequence: Synthetic peptide"
GGGGSGGGGSGGGGSGGGGS

SEQ ID NO: 999 - protein, 249 aa, Artificial Sequence
  source: /note="Description of Artificial Sequence: Synthetic polypeptide"
QVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSSGGGGSGGGGSGGGGSGGGGSAIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIK

SEQ ID NO: 1000 - DNA, 747 bp, Artificial Sequence
  source: /note="Description of Artificial Sequence: Synthetic polynucleotide"
caagtccaactcgtccagtccggtgcagaagtcaagaaacccggagcttccgtgaaagtgtcctgcaaagcctccggttacacctttacgaactactggatgcattgggtgcgccaggccccgggacaggggctggaatggatgggcttcattacccccaccaccggataccccgagtacaatcagaagttcaaggaccgggtcaccatgaccgccgacaagtcaacctctactgcttacatggagctgtccagcctgcggtcggaagataccgccgtgtattactgcgcgagaaggaaagtcggaaagggagtgtactatgccctggactactggggacaggggaccactgtgactgtgtcaagcggaggcggaggctcggggggcggaggttcgggcggaggaggatcagggggcggcggttccgcgatccgcatgacccagagcccgttctccctgtccgcgtccgtgggggaccgcgtgactatcacgtgtcgggcctccgggaacatccacaactacctcgcatggtaccagcagaagccggccaaggcccctaagttgttcatctacaacaccaagactcttgccgacggagtgccgtcccggtttagcggaagcggttccggcaccgactacaccctgactatctcgagcctgcaaccagaagatttcgccacttactactgccagcacttctggtcgtccccttggacattcggcggcggcaccaaggtcgagattaag

SEQ ID NO: 1001 - protein, 493 aa, Artificial Sequence
  source: /note="Description of Artificial Sequence: Synthetic polypeptide"
MALPVTALLLPLALLLHAARPQVQLVQSGAEVKKPGASVKVSCKASGYTFTNYWMHWVRQAPGQGLEWMGFITPTTGYPEYNQKFKDRVTMTADKSTSTAYMELSSLRSEDTAVYYCARRKVGKGVYYALDYWGQGTTVTVSSGGGGSGGGGSGGGGSGGGGSAIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1002 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtccggtgcagaagtcaagaaacccggagcttccgtgaaagtgtcctgcaaagcctccggttacacctttacgaactactggatgcattgggtgcgccaggccccgggacaggggctggaatggatgggcttcattacccccaccaccggataccccgagtacaatcagaagttcaaggaccgggtcaccatgaccgccgacaagtcaacctctactgcttacatggagctgtccagcctgcggtcggaagataccgccgtgtattactgcgcgagaaggaaagtcggaaagggagtgtactatgccctggactactggggacaggggaccactgtgactgtgtcaagcggaggcggaggctcggggggcggaggttcgggcggaggaggatcagggggcggcggttccgcgatccgcatgacccagagcccgttctccctgtccgcgtccgtgggggaccgcgtgactatcacgtgtcgggcctccgggaacatccacaactacctcgcatggtaccagcagaagccggccaaggcccctaagttgttcatctacaacaccaagactcttgccgacggagtgccgtcccggtttagcggaagcggttccggcaccgactacaccctgactatctcgagcctgcaaccagaagatttcgccacttactactgccagcacttctggtcgtccccttggacattcggcggcggcaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1003 - protein, 5 aa, Artificial Sequence
  source: /note="Description of Artificial Sequence: Synthetic peptide"
NYWMH

SEQ ID NO: 1004 - protein, 17 aa, Artificial Sequence
  source: /note="Description of Artificial Sequence: Synthetic peptide"
FITPTTGYPEYNQKFKD

SEQ ID NO: 1005 - protein, 13 aa, Artificial Sequence
  source: /note="Description of Artificial Sequence: Synthetic peptide"
RKVGKGVYYALDY

SEQ ID NO: 1006 - protein, 7 aa, Artificial Sequence
  source: /note="Description of Artificial Sequence: Synthetic peptide"
GYTFTNY

SEQ ID NO: 1007 - protein, 6 aa, Artificial Sequence
  source: /note="Description of Artificial Sequence: Synthetic peptide"
TPTTGY

SEQ ID NO: 1008 - protein, 13 aa, Artificial Sequence
  source: /note="Description of Artificial Sequence: Synthetic peptide"
RKVGKGVYYALDY

SEQ ID NO: 1009 - protein, 8 aa, Artificial Sequence
  source: /note="Description of Artificial Sequence: Synthetic peptide"
GYTFTNYW

SEQ ID NO: 1010 - protein, 8 aa, Artificial Sequence
  source: /note="Description of Artificial Sequence: Synthetic peptide"
ITPTTGYP

SEQ ID NO: 1011 - protein, 15 aa, Artificial Sequence
  source: /note="Description of Artificial Sequence: Synthetic peptide"
ARRKVGKGVYYALDY

SEQ ID NO: 1012 - protein, 10 aa, Artificial Sequence
  source: /note="Description of Artificial Sequence: Synthetic peptide"
GYTFTNYWMH

SEQ ID NO: 1013 - protein, 17 aa, Artificial Sequence
  source: /note="Description of Artificial Sequence: Synthetic peptide"
FITPTTGYPEYNQKFKD

SEQ ID NO: 1014 - protein, 13 aa, Artificial Sequence
  source: /note="Description of Artificial Sequence: Synthetic peptide"
RKVGKGVYYALDY

SEQ ID NO: 1015 - protein, 122 aa, Artificial Sequence; identical to SEQ ID NO: 949
  source: /note="Description of Artificial Sequence: Synthetic polypeptide"

SEQ ID NO: 1016 - DNA, 366 bp, Artificial Sequence
  source: /note="Description of Artificial Sequence: Synthetic polynucleotide"
caagtccaactcgtccaaagcggtgcagaagtcaagaagcccggttcctccgtgaaagtgtcctgcaaagcctcgggctacaccttcactaattactggatgcattgggtccgccaggcgcccggacagggattggaatggatggggttcatcacgccgaccaccggatacccggagtacaaccagaagttcaaggacagagtgaccattaccgccgataagtccacctccaccgcttacatggagctctcctcactgcggtccgaagatacagccgtgtactattgtgctcgccggaaagtcggaaagggagtgtactacgccctggactattggggccagggcaccaccgtgaccgtgtcctcg

SEQ ID NO: 1017 - protein, 11 aa, Artificial Sequence
  source: /note="Description of Artificial Sequence: Synthetic peptide"
RASGNIHNYLA

SEQ ID NO: 1018 - protein, 7 aa, Artificial Sequence
  source: /note="Description of Artificial Sequence: Synthetic peptide"
NTKTLAD

SEQ ID NO: 1019 - protein, 9 aa, Artificial Sequence
  source: /note="Description of Artificial Sequence: Synthetic peptide"
QHFWSSPWT

SEQ ID NO: 1020 - protein, 7 aa, Artificial Sequence
  source: /note="Description of Artificial Sequence: Synthetic peptide"
SGNIHNY

SEQ ID NO: 1021 - protein, 3 aa, Artificial Sequence
  source: /note="Description of Artificial Sequence: Synthetic peptide"
NTK

SEQ ID NO: 1022 - protein, 6 aa, Artificial Sequence
  source: /note="Description of Artificial Sequence: Synthetic peptide"
FWSSPW

SEQ ID NO: 1023 - protein, 6 aa, Artificial Sequence
  source: /note="Description of Artificial Sequence: Synthetic peptide"
GNIHNY

SEQ ID NO: 1024 - protein, 3 aa, Artificial Sequence
  source: /note="Description of Artificial Sequence: Synthetic peptide"
NTK

SEQ ID NO: 1025 - protein, 9 aa, Artificial Sequence
  source: /note="Description of Artificial Sequence: Synthetic peptide"
QHFWSSPWT

SEQ ID NO: 1026 - protein, 11 aa, Artificial Sequence
  source: /note="Description of Artificial Sequence: Synthetic peptide"
RASGNIHNYLA

SEQ ID NO: 1027 - protein, 7 aa, Artificial Sequence
  source: /note="Description of Artificial Sequence: Synthetic peptide"
NTKTLAD

SEQ ID NO: 1028 - protein, 9 aa, Artificial Sequence
  source: /note="Description of Artificial Sequence: Synthetic peptide"
QHFWSSPWT

SEQ ID NO: 1029 - protein, 107 aa, Artificial Sequence; identical to SEQ ID NO: 996
  source: /note="Description of Artificial Sequence: Synthetic polypeptide"

SEQ ID NO: 1030 - DNA, 321 bp, Artificial Sequence
  source: /note="Description of Artificial Sequence: Synthetic polynucleotide"
gccattaggatgactcagtcccctttctccctctccgcgagcgtgggcgaccgcgtgacgatcacttgccgggcctcggggaacattcacaactacctggcctggtaccagcagaagccggccaaggcccctaagctgttcatctacaacaccaagacccttgcggacggagtgccatcgagattttccggctcgggctctgggaccgattacactctgactatctcaagcctgcaacctgaggacttcgccacttactactgccagcacttctggagcagcccctggactttcggtggcgggaccaaggtcgaaatcaag

SEQ ID NO: 1031 - protein, 20 aa, Artificial Sequence
  source: /note="Description of Artificial Sequence: Synthetic peptide"
GGGGSGGGGSGGGGSGGGGS

SEQ ID NO: 1032 - protein, 249 aa, Artificial Sequence
  source: /note="Description of Artificial Sequence: Synthetic polypeptide"
QVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSSGGGGSGGGGSGGGGSGGGGSAIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIK

SEQ ID NO: 1033 - DNA, 747 bp, Artificial Sequence
  source: /note="Description of Artificial Sequence: Synthetic polynucleotide"
caagtccaactcgtccaaagcggtgcagaagtcaagaagcccggttcctccgtgaaagtgtcctgcaaagcctcgggctacaccttcactaattactggatgcattgggtccgccaggcgcccggacagggattggaatggatggggttcatcacgccgaccaccggatacccggagtacaaccagaagttcaaggacagagtgaccattaccgccgataagtccacctccaccgcttacatggagctctcctcactgcggtccgaagatacagccgtgtactattgtgctcgccggaaagtcggaaagggagtgtactacgccctggactattggggccagggcaccaccgtgaccgtgtcctcgggaggagggggttcgggcggaggcggctccggtggaggcggaagcggagggggcggatcagccattaggatgactcagtcccctttctccctctccgcgagcgtgggcgaccgcgtgacgatcacttgccgggcctcggggaacattcacaactacctggcctggtaccagcagaagccggccaaggcccctaagctgttcatctacaacaccaagacccttgcggacggagtgccatcgagattttccggctcgggctctgggaccgattacactctgactatctcaagcctgcaacctgaggacttcgccacttactactgccagcacttctggagcagcccctggactttcggtggcgggaccaaggtcgaaatcaag

SEQ ID NO: 1034 - protein, 493 aa, Artificial Sequence
  source: /note="Description of Artificial Sequence: Synthetic polypeptide"
MALPVTALLLPLALLLHAARPQVQLVQSGAEVKKPGSSVKVSCKASGYTFTNYWMHWVRQAPGQGLEWMGFITPTTGYPEYNQKFKDRVTITADKSTSTAYMELSSLRSEDTAVYYCARRKVGKGVYYALDYWGQGTTVTVSSGGGGSGGGGSGGGGSGGGGSAIRMTQSPFSLSASVGDRVTITCRASGNIHNYLAWYQQKPAKAPKLFIYNTKTLADGVPSRFSGSGSGTDYTLTISSLQPEDFATYYCQHFWSSPWTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1035 - DNA, 1479 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccaaagcggtgcagaagtcaagaagcccggttcctccgtgaaagtgtcctgcaaagcctcgggctacaccttcactaattactggatgcattgggtccgccaggcgcccggacagggattggaatggatggggttcatcacgccgaccaccggatacccggagtacaaccagaagttcaaggacagagtgaccattaccgccgataagtccacctccaccgcttacatggagctctcctcactgcggtccgaagatacagccgtgtactattgtgctcgccggaaagtcggaaagggagtgtactacgccctggactattggggccagggcaccaccgtgaccgtgtcctcgggaggagggggttcgggcggaggcggctccggtggaggcggaagcggagggggcggatcagccattaggatgactcagtcccctttctccctctccgcgagcgtgggcgaccgcgtgacgatcacttgccgggcctcggggaacattcacaactacctggcctggtaccagcagaagccggccaaggcccctaagctgttcatctacaacaccaagacccttgcggacggagtgccatcgagattttccggctcgggctctgggaccgattacactctgactatctcaagcctgcaacctgaggacttcgccacttactactgccagcacttctggagcagcccctggactttcggtggcgggaccaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1036 - protein, 5 aa, Artificial Sequence
  source: /note="Description of Artificial Sequence: Synthetic peptide"
NYNLH

SEQ ID NO: 1037 - protein, 17 aa, Artificial Sequence
  source: /note="Description of Artificial Sequence: Synthetic peptide"
AIYPGNYDTSYNQKFKG

SEQ ID NO: 1038 - protein, 13 aa, Artificial Sequence
  source: /note="Description of Artificial Sequence: Synthetic peptide"
VDFGHSRYWYFDV

SEQ ID NO: 1039 - protein, 7 aa, Artificial Sequence
  source: /note="Description of Artificial Sequence: Synthetic peptide"
GYTFTNY

SEQ ID NO: 1040 - protein, 6 aa, Artificial Sequence
  source: /note="Description of Artificial Sequence: Synthetic peptide"
YPGNYD

SEQ ID NO: 1041 - protein, 13 aa, Artificial Sequence
  source: /note="Description of Artificial Sequence: Synthetic peptide"
VDFGHSRYWYFDV

SEQ ID NO: 1042 - protein, 8 aa, Artificial Sequence
  source: /note="Description of Artificial Sequence: Synthetic peptide"
GYTFTNYN

SEQ ID NO: 1043 - protein, 8 aa, Artificial Sequence
  source: /note="Description of Artificial Sequence: Synthetic peptide"
IYPGNYDT

SEQ ID NO: 1044 - protein, 15 aa, Artificial Sequence
  source: /note="Description of Artificial Sequence: Synthetic peptide"
ARVDFGHSRYWYFDV

SEQ ID NO: 1045 - protein, 10 aa, Artificial Sequence
  source: /note="Description of Artificial Sequence: Synthetic peptide"
GYTFTNYNLH

SEQ ID NO: 1046 - protein, 17 aa, Artificial Sequence
  source: /note="Description of Artificial Sequence: Synthetic peptide"
AIYPGNYDTSYNQKFKG

SEQ ID NO: 1047 - protein, 13 aa, Artificial Sequence
  source: /note="Description of Artificial Sequence: Synthetic peptide"
VDFGHSRYWYFDV

SEQ ID NO: 1048 - protein, 122 aa, Artificial Sequence; identical to SEQ ID NO: 850
  source: /note="Description of Artificial Sequence: Synthetic polypeptide"

SEQ ID NO: 1049 - DNA, 366 bp, Artificial Sequence
  source: /note="Description of Artificial Sequence: Synthetic polynucleotide"
caagtccaactcgtccaatccggtgcagaagtcaagaaacccggtgcatccgtgaaagtgtcatgcaaagcctccgggtacaccttcactaactacaacctccactgggtccgccaggccccgggacagggactggagtggatgggggccatctacccgggaaactacgacacttcatacaaccagaagttcaagggcagagtgaccatgactgccgacaagagcacatcgaccgcctacatggaactcagctccctgcgctccgaggatactgccgtctactactgtgcccgggtggacttcggccactcccggtattggtatttcgatgtctggggacagggaaccaccgtgactgtgtccagc

SEQ ID NO: 1050 - protein, 10 aa, Artificial Sequence
  source: /note="Description of Artificial Sequence: Synthetic peptide"
RATSSVSSMN

SEQ ID NO: 1051 - protein, 7 aa, Artificial Sequence
  source: /note="Description of Artificial Sequence: Synthetic peptide"
ATSNLAS

SEQ ID NO: 1052 - protein, 9 aa, Artificial Sequence
  source: /note="Description of Artificial Sequence: Synthetic peptide"
QQWTFNPPT

SEQ ID NO: 1053 - protein, 6 aa, Artificial Sequence
  source: /note="Description of Artificial Sequence: Synthetic peptide"
TSSVSS

SEQ ID NO: 1054 - protein, 3 aa, Artificial Sequence
  source: /note="Description of Artificial Sequence: Synthetic peptide"
ATS

SEQ ID NO: 1055 - protein, 6 aa, Artificial Sequence
  source: /note="Description of Artificial Sequence: Synthetic peptide"
WTFNPP

SEQ ID NO: 1056 - protein, 5 aa, Artificial Sequence
  source: /note="Description of Artificial Sequence: Synthetic peptide"
SSVSS

SEQ ID NO: 1057 - protein, 3 aa, Artificial Sequence
  source: /note="Description of Artificial Sequence: Synthetic peptide"
ATS

SEQ ID NO: 1058 - protein, 9 aa, Artificial Sequence
  source: /note="Description of Artificial Sequence: Synthetic peptide"
QQWTFNPPT

SEQ ID NO: 1059 - protein, 10 aa, Artificial Sequence
  source: /note="Description of Artificial Sequence: Synthetic peptide"
RATSSVSSMN

SEQ ID NO: 1060 - protein, 7 aa, Artificial Sequence
  source: /note="Description of Artificial Sequence: Synthetic peptide"
ATSNLAS

SEQ ID NO: 1061 - protein, 9 aa, Artificial Sequence
  source: /note="Description of Artificial Sequence: Synthetic peptide"
QQWTFNPPT

SEQ ID NO: 1062 - protein, 106 aa, Artificial Sequence
  source: /note="Description of Artificial Sequence: Synthetic polypeptide"
EIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIK

SEQ ID NO: 1063 - DNA, 318 bp, Artificial Sequence
  source: /note="Description of Artificial Sequence: Synthetic polynucleotide"
gaaatcgtgctgacccagtcccctgcgactctgagcctgagccctggggaacgcgccactttgtcatgccgggccacctcctccgtgtcctccatgaactggtaccagcagaagcccggacaggctccgcggccgctgatccatgccacctccaacctggccagcggcattcccgcgaggttttccggctcgggctctggtaccgactacaccctgaccatctcgagccttgagccagaagatgctgcggtgtactactgccaacagtggaccttcaatccgcctacgttcggacaggggaccaagctggagattaag

SEQ ID NO: 1064 - protein, 20 aa, Artificial Sequence
  source: /note="Description of Artificial Sequence: Synthetic peptide"
GGGGSGGGGSGGGGSGGGGS

SEQ ID NO: 1065 - protein, 248 aa, Artificial Sequence
  source: /note="Description of Artificial Sequence: Synthetic polypeptide"
QVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSSGGGGSGGGGSGGGGSGGGGSEIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIK

SEQ ID NO: 1066 - DNA, 744 bp, Artificial Sequence
  source: /note="Description of Artificial Sequence: Synthetic polynucleotide"
caagtccaactcgtccaatccggtgcagaagtcaagaaacccggtgcatccgtgaaagtgtcatgcaaagcctccgggtacaccttcactaactacaacctccactgggtccgccaggccccgggacagggactggagtggatgggggccatctacccgggaaactacgacacttcatacaaccagaagttcaagggcagagtgaccatgactgccgacaagagcacatcgaccgcctacatggaactcagctccctgcgctccgaggatactgccgtctactactgtgcccgggtggacttcggccactcccggtattggtatttcgatgtctggggacagggaaccaccgtgactgtgtccagcgggggcggaggatcgggtggcggaggttcggggggaggaggatcaggcggcggcggatcggaaatcgtgctgacccagtcccctgcgactctgagcctgagccctggggaacgcgccactttgtcatgccgggccacctcctccgtgtcctccatgaactggtaccagcagaagcccggacaggctccgcggccgctgatccatgccacctccaacctggccagcggcattcccgcgaggttttccggctcgggctctggtaccgactacaccctgaccatctcgagccttgagccagaagatgctgcggtgtactactgccaacagtggaccttcaatccgcctacgttcggacaggggaccaagctggagattaag

SEQ ID NO: 1067 - protein, 492 aa, Artificial Sequence
  source: /note="Description of Artificial Sequence: Synthetic polypeptide"
MALPVTALLLPLALLLHAARPQVQLVQSGAEVKKPGASVKVSCKASGYTFTNYNLHWVRQAPGQGLEWMGAIYPGNYDTSYNQKFKGRVTMTADKSTSTAYMELSSLRSEDTAVYYCARVDFGHSRYWYFDVWGQGTTVTVSSGGGGSGGGGSGGGGSGGGGSEIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1068 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccaatccggtgcagaagtcaagaaacccggtgcatccgtgaaagtgtcatgcaaagcctccgggtacaccttcactaactacaacctccactgggtccgccaggccccgggacagggactggagtggatgggggccatctacccgggaaactacgacacttcatacaaccagaagttcaagggcagagtgaccatgactgccgacaagagcacatcgaccgcctacatggaactcagctccctgcgctccgaggatactgccgtctactactgtgcccgggtggacttcggccactcccggtattggtatttcgatgtctggggacagggaaccaccgtgactgtgtccagcgggggcggaggatcgggtggcggaggttcggggggaggaggatcaggcggcggcggatcggaaatcgtgctgacccagtcccctgcgactctgagcctgagccctggggaacgcgccactttgtcatgccgggccacctcctccgtgtcctccatgaactggtaccagcagaagcccggacaggctccgcggccgctgatccatgccacctccaacctggccagcggcattcccgcgaggttttccggctcgggctctggtaccgactacaccctgaccatctcgagccttgagccagaagatgctgcggtgtactactgccaacagtggaccttcaatccgcctacgttcggacaggggaccaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1069 - protein, 5 aa, Artificial Sequence
  source: /note="Description of Artificial Sequence: Synthetic peptide"
NYNLH

SEQ ID NO: 1070 - protein, 17 aa, Artificial Sequence
  source: /note="Description of Artificial Sequence: Synthetic peptide"
AIYPGNYDTSYNQKFKG

SEQ ID NO: 1071 - protein, 13 aa, Artificial Sequence
  source: /note="Description of Artificial Sequence: Synthetic peptide"
VDFGHSRYWYFDV

SEQ ID NO: 1072 - protein, 7 aa, Artificial Sequence
  source: /note="Description of Artificial Sequence: Synthetic peptide"
GYTFTNY

SEQ ID NO: 1073 - protein, 6 aa, Artificial Sequence
  source: /note="Description of Artificial Sequence: Synthetic peptide"
YPGNYD

SEQ ID NO: 1074 - protein, 13 aa, Artificial Sequence
  source: /note="Description of Artificial Sequence: Synthetic peptide"
VDFGHSRYWYFDV

SEQ ID NO: 1075 - protein, 8 aa, Artificial Sequence
  source: /note="Description of Artificial Sequence: Synthetic peptide"
GYTFTNYN

SEQ ID NO: 1076 - protein, 8 aa, Artificial Sequence
  source: /note="Description of Artificial Sequence: Synthetic peptide"
IYPGNYDT

SEQ ID NO: 1077 - protein, 15 aa, Artificial Sequence
  source: /note="Description of Artificial Sequence: Synthetic peptide"
ARVDFGHSRYWYFDV

SEQ ID NO: 1078 - protein, 122 aa, Artificial Sequence; identical to SEQ ID NO: 916
  source: /note="Description of Artificial Sequence: Synthetic polypeptide"

SEQ ID NO: 1079 - DNA, 366 bp, Artificial Sequence
  source: /note="Description of Artificial Sequence: Synthetic polynucleotide"
caagtccaactcgtccagtcgggagcagaagtcaagaagcccggatcatccgtgaaagtgtcctgcaaagcctcaggctacacctttaccaactacaacttgcactgggtcagacaggccccgggacagggcctggagtggatgggcgccatctaccccggaaactatgacacctcgtacaaccagaagttcaagggtcgcgtgactatcacggctgacaagtccactagcaccgcgtacatggaactttcctcactgcggtccgaggatactgcggtgtactactgcgcccgggtggacttcggacactcgagatattggtacttcgatgtctggggacaggggaccaccgtgactgtgtcctcc

SEQ ID NO: 1080 - protein, 10 aa, Artificial Sequence
  source: /note="Description of Artificial Sequence: Synthetic peptide"
RATSSVSSMN

SEQ ID NO: 1081 - protein, 7 aa, Artificial Sequence
  source: /note="Description of Artificial Sequence: Synthetic peptide"
ATSNLAS

SEQ ID NO: 1082 - protein, 9 aa, Artificial Sequence
  source: /note="Description of Artificial Sequence: Synthetic peptide"
QQWTFNPPT

SEQ ID NO: 1083 - protein, 6 aa, Artificial Sequence
  source: /note="Description of Artificial Sequence: Synthetic peptide"
TSSVSS

SEQ ID NO: 1084 - protein, 3 aa, Artificial Sequence
  source: /note="Description of Artificial Sequence: Synthetic peptide"
ATS

SEQ ID NO: 1085 - protein, 6 aa, Artificial Sequence
  source: /note="Description of Artificial Sequence: Synthetic peptide"
WTFNPP

SEQ ID NO: 1086 - protein, 5 aa, Artificial Sequence
  source: /note="Description of Artificial Sequence: Synthetic peptide"
SSVSS

SEQ ID NO: 1087 - protein, 3 aa, Artificial Sequence
  source: /note="Description of Artificial Sequence: Synthetic peptide"
ATS

SEQ ID NO: 1088 - protein, 9 aa, Artificial Sequence
  source: /note="Description of Artificial Sequence: Synthetic peptide"
QQWTFNPPT

SEQ ID NO: 1089 - protein, 10 aa, Artificial Sequence
  source: /note="Description of Artificial Sequence: Synthetic peptide"
RATSSVSSMN

SEQ ID NO: 1090 - protein, 7 aa, Artificial Sequence
  source: /note="Description of Artificial Sequence: Synthetic peptide"
ATSNLAS

SEQ ID NO: 1091 - protein, 9 aa, Artificial Sequence
  source: /note="Description of Artificial Sequence: Synthetic peptide"
QQWTFNPPT

SEQ ID NO: 1092 - protein, 107 aa, Artificial Sequence; identical to SEQ ID NO: 996
  source: /note="Description of Artificial Sequence: Synthetic polypeptide"

SEQ ID NO: 1093 - DNA, 318 bp, Artificial Sequence
  source: /note="Description of Artificial Sequence: Synthetic polynucleotide"
gaaattgtgctgacccagtctcccgcaaccctgtccctgagccctggagagcgcgccaccctgtcctgccgggccacatcctccgtgtcgtccatgaactggtaccagcagaagcccggccaagccccgaggcctctgattcatgctacctcaaatctggccagcggaatcccggcgcgcttctccggctcgggcagcggtactgactacactctcaccatctcgtccctcgaaccggaggacgccgccgtctactactgtcagcagtggaccttcaacccacctactttcggacaagggaccaagctggagatcaag

SEQ ID NO: 1094 - protein, 19 aa, Artificial Sequence
  source: /note="Description of Artificial Sequence: Synthetic peptide"
GGGSGGGGSGGGGSGGGGS

SEQ ID NO: 1095 - protein, 249 aa, Artificial Sequence; identical to SEQ ID NO: 999
  source: /note="Description of Artificial Sequence: Synthetic polypeptide"

SEQ ID NO: 1096 - DNA, 744 bp, Artificial Sequence
  source: /note="Description of Artificial Sequence: Synthetic polynucleotide"
caagtccaactcgtccagtcgggagcagaagtcaagaagcccggatcatccgtgaaagtgtcctgcaaagcctcaggctacacctttaccaactacaacttgcactgggtcagacaggccccgggacagggcctggagtggatgggcgccatctaccccggaaactatgacacctcgtacaaccagaagttcaagggtcgcgtgactatcacggctgacaagtccactagcaccgcgtacatggaactttcctcactgcggtccgaggatactgcggtgtactactgcgcccgggtggacttcggacactcgagatattggtacttcgatgtctggggacaggggaccaccgtgactgtgtcctccgggggcggtggcagcgggggaggcggaagcggcggagggggttccgggggtggaggaagcgaaattgtgctgacccagtctcccgcaaccctgtccctgagccctggagagcgcgccaccctgtcctgccgggccacatcctccgtgtcgtccatgaactggtaccagcagaagcccggccaagccccgaggcctctgattcatgctacctcaaatctggccagcggaatcccggcgcgcttctccggctcgggcagcggtactgactacactctcaccatctcgtccctcgaaccggaggacgccgccgtctactactgtcagcagtggaccttcaacccacctactttcggacaagggaccaagctggagatcaag

SEQ ID NO: 1097 - protein, 492 aa, Artificial Sequence
  source: /note="Description of Artificial Sequence: Synthetic polypeptide"
MALPVTALLLPLALLLHAARPQVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSSGGGGSGGGGSGGGGSGGGGSEIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1098 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtcgggagcagaagtcaagaagcccggatcatccgtgaaagtgtcctgcaaagcctcaggctacacctttaccaactacaacttgcactgggtcagacaggccccgggacagggcctggagtggatgggcgccatctaccccggaaactatgacacctcgtacaaccagaagttcaagggtcgcgtgactatcacggctgacaagtccactagcaccgcgtacatggaactttcctcactgcggtccgaggatactgcggtgtactactgcgcccgggtggacttcggacactcgagatattggtacttcgatgtctggggacaggggaccaccgtgactgtgtcctccgggggcggtggcagcgggggaggcggaagcggcggagggggttccgggggtggaggaagcgaaattgtgctgacccagtctcccgcaaccctgtccctgagccctggagagcgcgccaccctgtcctgccgggccacatcctccgtgtcgtccatgaactggtaccagcagaagcccggccaagccccgaggcctctgattcatgctacctcaaatctggccagcggaatcccggcgcgcttctccggctcgggcagcggtactgactacactctcaccatctcgtccctcgaaccggaggacgccgccgtctactactgtcagcagtggaccttcaacccacctactttcggacaagggaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1099 - protein, 5 aa, Artificial Sequence
  source: /note="Description of Artificial Sequence: Synthetic peptide"
NYNLH

SEQ ID NO: 1100 - protein, 17 aa, Artificial Sequence
  source: /note="Description of Artificial Sequence: Synthetic peptide"
AIYPGNYDTSYNQKFKG

SEQ ID NO: 1101 - protein, 13 aa, Artificial Sequence
  source: /note="Description of Artificial Sequence: Synthetic peptide"
VDFGHSRYWYFDV

SEQ ID NO: 1102 - protein, 7 aa, Artificial Sequence
  source: /note="Description of Artificial Sequence: Synthetic peptide"
GYTFTNY

SEQ ID NO: 1103 - protein, 6 aa, Artificial Sequence
  source: /note="Description of Artificial Sequence: Synthetic peptide"
YPGNYD

SEQ ID NO: 1104 - protein, 13 aa, Artificial Sequence
  source: /note="Description of Artificial Sequence: Synthetic peptide"
VDFGHSRYWYFDV

SEQ ID NO: 1105 - protein, 8 aa, Artificial Sequence
  source: /note="Description of Artificial Sequence: Synthetic peptide"
GYTFTNYN

SEQ ID NO: 1106 - protein, 8 aa, Artificial Sequence
  source: /note="Description of Artificial Sequence: Synthetic peptide"
IYPGNYDT

SEQ ID NO: 1107 - protein, 15 aa, Artificial Sequence
  source: /note="Description of Artificial Sequence: Synthetic peptide"
ARVDFGHSRYWYFDV

SEQ ID NO: 1108 - protein, 10 aa, Artificial Sequence
  source: /note="Description of Artificial Sequence: Synthetic peptide"
GYTFTNYNLH

SEQ ID NO: 1109 - protein, 17 aa, Artificial Sequence
  source: /note="Description of Artificial Sequence: Synthetic peptide"
AIYPGNYDTSYNQKFKG

SEQ ID NO: 1110 - protein, 13 aa, Artificial Sequence
  source: /note="Description of Artificial Sequence: Synthetic peptide"
VDFGHSRYWYFDV

SEQ ID NO: 1111 - protein, 122 aa, Artificial Sequence
  source: /note="Description of Artificial Sequence: Synthetic polypeptide"
QVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSS

SEQ ID NO: 1112 - DNA, 366 bp, Artificial Sequence; identical to SEQ ID NO: 1079
  source: /note="Description of Artificial Sequence: Synthetic polynucleotide"

SEQ ID NO: 1113 - protein, 10 aa, Artificial Sequence
  source: /note="Description of Artificial Sequence: Synthetic peptide"
RATSSVSSMN

SEQ ID NO: 1114 - protein, 7 aa, Artificial Sequence
  source: /note="Description of Artificial Sequence: Synthetic peptide"
ATSNLAS

SEQ ID NO: 1115 - protein, 9 aa, Artificial Sequence
  source: /note="Description of Artificial Sequence: Synthetic peptide"
QQWTFNPPT

SEQ ID NO: 1116 - protein, 6 aa, Artificial Sequence
  source: /note="Description of Artificial Sequence: Synthetic peptide"
TSSVSS

SEQ ID NO: 1117 - protein, 3 aa, Artificial Sequence
  source: /note="Description of Artificial Sequence: Synthetic peptide"
ATS

SEQ ID NO: 1118 - protein, 6 aa, Artificial Sequence
  source: /note="Description of Artificial Sequence: Synthetic peptide"
WTFNPP

SEQ ID NO: 1119 - protein, 5 aa, Artificial Sequence
  source: /note="Description of Artificial Sequence: Synthetic peptide"
SSVSS

SEQ ID NO: 1120 - protein, 3 aa, Artificial Sequence
  source: /note="Description of Artificial Sequence: Synthetic peptide"
ATS

SEQ ID NO: 1121 - protein, 9 aa, Artificial Sequence
  source: /note="Description of Artificial Sequence: Synthetic peptide"
QQWTFNPPT

SEQ ID NO: 1122 - protein, 10 aa, Artificial Sequence
  source: /note="Description of Artificial Sequence: Synthetic peptide"
RATSSVSSMN

SEQ ID NO: 1123 - protein, 7 aa, Artificial Sequence
  source: /note="Description of Artificial Sequence: Synthetic peptide"
ATSNLAS

SEQ ID NO: 1124 - protein, 9 aa, Artificial Sequence
  source: /note="Description of Artificial Sequence: Synthetic peptide"
QQWTFNPPT

SEQ ID NO: 1125 - protein, 106 aa, Artificial Sequence; identical to SEQ ID NO: 1062
  source: /note="Description of Artificial Sequence: Synthetic polypeptide"

SEQ ID NO: 1126 - DNA, 318 bp, Artificial Sequence; identical to SEQ ID NO: 1093
  source: /note="Description of Artificial Sequence: Synthetic polynucleotide"

SEQ ID NO: 1127 - protein, 20 aa, Artificial Sequence
  source: /note="Description of Artificial Sequence: Synthetic peptide"
GGGGSGGGGSGGGGSGGGGS

SEQ ID NO: 1128 - protein, 248 aa, Artificial Sequence
  source: /note="Description of Artificial Sequence: Synthetic polypeptide"
QVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSSGGGGSGGGGSGGGGSGGGGSEIVLTQSPATLSLSPGERATLSCRATSSVSSMNWYQQKPGQAPRPLIHATSNLASGIPARFSGSGSGTDYTLTISSLEPEDAAVYYCQQWTFNPPTFGQGTKLEIK

SEQ ID NO: 1129 - DNA, 744 bp, Artificial Sequence
  source: /note="Description of Artificial Sequence: Synthetic polynucleotide"
caagtccaactcgtccaatccggcgcagaagtcaagaaaccaggatcgtccgtgaaagtgtcctgcaaggcgtccgggtacaccttcactaattacaacctccactgggtcagacaggccccaggacagggcctggaatggatgggcgccatctaccctggaaactacgatacctcgtacaaccagaagttcaagggccgcgtgactattaccgccgacaagagcacctccaccgcctatatggaactgtcgtccctgcggtccgaggacactgccgtgtactactgtgcaagggtggacttcggtcactcccggtattggtacttcgacgtctggggacaggggaccactgtgaccgtgtcgtcgggaggcggtggaagcggcggtggcggaagcggaggcggcggatcagggggcggaggaagcgacattcagcttacccagtcaccgtccttcctgagcgcctccgtgggagatcgcgtgaccatcacatgccgcgccacttcctcggtgtcctccatgaactggtaccagcagaagcccggaaaggctcctaagcctctgatccatgcgacctccaacttggcttccggggtgccgtcacggttcagcggcagcggttcaggaactgagtacaccctgactattagctctctccaacccgaggacttcgccacctactactgccagcagtggaccttcaacccgcccacgtttgggcagggtaccaagctggagatcaag

SEQ ID NO: 1130 - protein, 492 aa, Artificial Sequence
  source: /note="Description of Artificial Sequence: Synthetic polypeptide"
MALPVTALLLPLALLLHAARPQVQLVQSGAEVKKPGSSVKVSCKASGYTFTNYNLHWVRQAPGQGLEWMGAIYPGNYDTSYNQKFKGRVTITADKSTSTAYMELSSLRSEDTAVYYCARVDFGHSRYWYFDVWGQGTTVTVSSGGGGSGGGGSGGGGSGGGGSDIQLTQSPSFLSASVGDRVTITCRATSSVSSMNWYQQKPGKAPKPLIHATSNLASGVPSRFSGSGSGTEYTLTISSLQPEDFATYYCQQWTFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1131 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccaatccggcgcagaagtcaagaaaccaggatcgtccgtgaaagtgtcctgcaaggcgtccgggtacaccttcactaattacaacctccactgggtcagacaggccccaggacagggcctggaatggatgggcgccatctaccctggaaactacgatacctcgtacaaccagaagttcaagggccgcgtgactattaccgccgacaagagcacctccaccgcctatatggaactgtcgtccctgcggtccgaggacactgccgtgtactactgtgcaagggtggacttcggtcactcccggtattggtacttcgacgtctggggacaggggaccactgtgaccgtgtcgtcgggaggcggtggaagcggcggtggcggaagcggaggcggcggatcagggggcggaggaagcgacattcagcttacccagtcaccgtccttcctgagcgcctccgtgggagatcgcgtgaccatcacatgccgcgccacttcctcggtgtcctccatgaactggtaccagcagaagcccggaaaggctcctaagcctctgatccatgcgacctccaacttggcttccggggtgccgtcacggttcagcggcagcggttcaggaactgagtacaccctgactattagctctctccaacccgaggacttcgccacctactactgccagcagtggaccttcaacccgcccacgtttgggcagggtaccaagctggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1132 - protein, 5 aa, Artificial Sequence
  source: /note="Description of Artificial Sequence: Synthetic peptide"
SYNMH

SEQ ID NO: 1133 - protein, 17 aa, Artificial Sequence
  source: /note="Description of Artificial Sequence: Synthetic peptide"
AIYPGNGDTSYNPKFKG

SEQ ID NO: 1134 - protein, 13 aa, Artificial Sequence
  source: /note="Description of Artificial Sequence: Synthetic peptide"
SYFYGSSSWYFDV

SEQ ID NO: 1135 - protein, 7 aa, Artificial Sequence
  source: /note="Description of Artificial Sequence: Synthetic peptide"
GYTFTSY

SEQ ID NO: 1136 - protein, 6 aa, Artificial Sequence
  source: /note="Description of Artificial Sequence: Synthetic peptide"
YPGNGD

SEQ ID NO: 1137 - protein, 13 aa, Artificial Sequence
  source: /note="Description of Artificial Sequence: Synthetic peptide"
SYFYGSSSWYFDV

SEQ ID NO: 1138 - protein, 8 aa, Artificial Sequence
  source: /note="Description of Artificial Sequence: Synthetic peptide"
GYTFTSYN

SEQ ID NO: 1139 - protein, 8 aa, Artificial Sequence
  source: /note="Description of Artificial Sequence: Synthetic peptide"
IYPGNGDT

SEQ ID NO: 1140 - protein, 15 aa, Artificial Sequence
  source: /note="Description of Artificial Sequence: Synthetic peptide"
ARSYFYGSSSWYFDV

SEQ ID NO: 1141 - protein, 10 aa, Artificial Sequence
  source: /note="Description of Artificial Sequence: Synthetic peptide"
GYTFTSYNMH

SEQ ID NO: 1142 - protein, 17 aa, Artificial Sequence
  source: /note="Description of Artificial Sequence: Synthetic peptide"
AIYPGNGDTSYNPKFKG

SEQ ID NO: 1143 - protein, 13 aa, Artificial Sequence
  source: /note="Description of Artificial Sequence: Synthetic peptide"
SYFYGSSSWYFDV

SEQ ID NO: 1144 - protein, 122 aa, Artificial Sequence; identical to SEQ ID NO: 883
  source: /note="Description of Artificial Sequence: Synthetic polypeptide"

SEQ ID NO: 1145 - DNA, 366 bp, Artificial Sequence
  source: /note="Description of Artificial Sequence: Synthetic polynucleotide"
caagtccaactcgtccagtcaggagcagaagtcaagaaacctggagcttccgtgaaagtgtcgtgcaaggcctccggctacaccttcacctcttacaacatgcactgggtcagacaggcccctggtcaaggactggaatggatgggagcgatctacccgggcaacggagacacttcgtacaaccccaagttcaagggacgggtcactatgaccgccgataagagcacgcgcaccgcgtacatggaactgagcagcctgcgctccgaggacactgccgtgtattactgcgcgaggagctacttctacggatcatcgtcgtggtacttcgacgtctggggccagggcaccaccgtgaccgtgtcatcc

SEQ ID NO: 1146 - protein, 10 aa, Artificial Sequence
  source: /note="Description of Artificial Sequence: Synthetic peptide"
RASSSVSSMH

SEQ ID NO: 1147 - protein, 7 aa, Artificial Sequence
  source: /note="Description of Artificial Sequence: Synthetic peptide"
ATSNLAS

SEQ ID NO: 1148 - protein, 9 aa, Artificial Sequence
  source: /note="Description of Artificial Sequence: Synthetic peptide"
QQWIFNPPT

SEQ ID NO: 1149 - protein, 6 aa, Artificial Sequence
  source: /note="Description of Artificial Sequence: Synthetic peptide"
SSSVSS

SEQ ID NO: 1150 - protein, 3 aa, Artificial Sequence
  source: /note="Description of Artificial Sequence: Synthetic peptide"
ATS

SEQ ID NO: 1151 - protein, 6 aa, Artificial Sequence
  source: /note="Description of Artificial Sequence: Synthetic peptide"
WIFNPP

SEQ ID NO: 1152 - protein, 5 aa, Artificial Sequence
  source: /note="Description of Artificial Sequence: Synthetic peptide"
SSVSS

SEQ ID NO: 1153 - protein, 3 aa, Artificial Sequence
  source: /note="Description of Artificial Sequence: Synthetic peptide"
ATS

SEQ ID NO: 1154 - protein, 9 aa, Artificial Sequence
  source: /note="Description of Artificial Sequence: Synthetic peptide"
QQWIFNPPT

SEQ ID NO: 1155 - protein, 10 aa, Artificial Sequence
  source: /note="Description of Artificial Sequence: Synthetic peptide"
RASSSVSSMH

SEQ ID NO: 1156 - protein, 7 aa, Artificial Sequence
  source: /note="Description of Artificial Sequence: Synthetic peptide"
ATSNLAS

SEQ ID NO: 1157 - protein, 9 aa, Artificial Sequence
  source: /note="Description of Artificial Sequence: Synthetic peptide"
QQWIFNPPT

SEQ ID NO: 1158 - protein, 106 aa, Artificial Sequence
  source: /note="Description of Artificial Sequence: Synthetic polypeptide"
DIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIK

SEQ ID NO: 1159 - DNA, 318 bp, Artificial Sequence
  source: /note="Description of Artificial Sequence: Synthetic polynucleotide"
gatattcagctgacccagagcccgtcattcctgtccgcctccgtgggagacagagtgaccatcacttgtcgggccagctcctcggtgtcctccatgcattggtatcagcagaagcctgggaaggctcccaagcccctcatcttcgccacatcaaatcttgcctccggggtgccaagccggttctccgggagcggctccggtactgagtacactctgaccatttcctccttgcaacccgaggactttgccacctactactgccagcagtggatctttaacccgccgaccttcggaggaggaaccaaagtggagatcaag

SEQ ID NO: 1160 - protein, 20 aa, Artificial Sequence
  source: /note="Description of Artificial Sequence: Synthetic peptide"
GGGGSGGGGSGGGGSGGGGS

SEQ ID NO: 1161 - protein, 248 aa, Artificial Sequence
  source: /note="Description of Artificial Sequence: Synthetic polypeptide"
QVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSDIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIK

SEQ ID NO: 1162 - DNA, 744 bp, Artificial Sequence
  source: /note="Description of Artificial Sequence: Synthetic polynucleotide"
caagtccaactcgtccagtcaggagcagaagtcaagaaacctggagcttccgtgaaagtgtcgtgcaaggcctccggctacaccttcacctcttacaacatgcactgggtcagacaggcccctggtcaaggactggaatggatgggagcgatctacccgggcaacggagacacttcgtacaaccccaagttcaagggacgggtcactatgaccgccgataagagcacgcgcaccgcgtacatggaactgagcagcctgcgctccgaggacactgccgtgtattactgcgcgaggagctacttctacggatcatcgtcgtggtacttcgacgtctggggccagggcaccaccgtgaccgtgtcatccggtggcggaggatcggggggcggaggaagcggcggggggggctccggcggtggaggctcggatattcagctgacccagagcccgtcattcctgtccgcctccgtgggagacagagtgaccatcacttgtcgggccagctcctcggtgtcctccatgcattggtatcagcagaagcctgggaaggctcccaagcccctcatcttcgccacatcaaatcttgcctccggggtgccaagccggttctccgggagcggctccggtactgagtacactctgaccatttcctccttgcaacccgaggactttgccacctactactgccagcagtggatctttaacccgccgaccttcggaggaggaaccaaagtggagatcaag

SEQ ID NO: 1163 - protein, 492 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYNMHWVRQAPGQGLEWMGAIYPGNGDTSYNPKFKGRVTMTADKSTRTAYMELSSLRSEDTAVYYCARSYFYGSSSWYFDVWGQGTTVTVSSGGGGSGGGGSGGGGSGGGGSDIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1164 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtcaggagcagaagtcaagaaacctggagcttccgtgaaagtgtcgtgcaaggcctccggctacaccttcacctcttacaacatgcactgggtcagacaggcccctggtcaaggactggaatggatgggagcgatctacccgggcaacggagacacttcgtacaaccccaagttcaagggacgggtcactatgaccgccgataagagcacgcgcaccgcgtacatggaactgagcagcctgcgctccgaggacactgccgtgtattactgcgcgaggagctacttctacggatcatcgtcgtggtacttcgacgtctggggccagggcaccaccgtgaccgtgtcatccggtggcggaggatcggggggcggaggaagcggcggggggggctccggcggtggaggctcggatattcagctgacccagagcccgtcattcctgtccgcctccgtgggagacagagtgaccatcacttgtcgggccagctcctcggtgtcctccatgcattggtatcagcagaagcctgggaaggctcccaagcccctcatcttcgccacatcaaatcttgcctccggggtgccaagccggttctccgggagcggctccggtactgagtacactctgaccatttcctccttgcaacccgaggactttgccacctactactgccagcagtggatctttaacccgccgaccttcggaggaggaaccaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1165 - protein, 5 aa, Artificial Sequence
  source: /note="Description of Artificial Sequence: Synthetic peptide"
SYNMH

SEQ ID NO: 1166 - protein, 17 aa, Artificial Sequence
  source: /note="Description of Artificial Sequence: Synthetic peptide"
AIYPGNGDTSYNPKFKG

SEQ ID NO: 1167 - protein, 13 aa, Artificial Sequence
  source: /note="Description of Artificial Sequence: Synthetic peptide"
SYFYGSSSWYFDV

SEQ ID NO: 1168 - protein, 7 aa, Artificial Sequence
  source: /note="Description of Artificial Sequence: Synthetic peptide"
GYTFTSY

SEQ ID NO: 1169 - protein, 6 aa, Artificial Sequence
  source: /note="Description of Artificial Sequence: Synthetic peptide"
YPGNGD

SEQ ID NO: 1170 - protein, 13 aa, Artificial Sequence
  source: /note="Description of Artificial Sequence: Synthetic peptide"
SYFYGSSSWYFDV

SEQ ID NO: 1171 - protein, 8 aa, Artificial Sequence
  source: /note="Description of Artificial Sequence: Synthetic peptide"
GYTFTSYN

SEQ ID NO: 1172 - protein, 8 aa, Artificial Sequence
  source: /note="Description of Artificial Sequence: Synthetic peptide"
IYPGNGDT

SEQ ID NO: 1173 - protein, 15 aa, Artificial Sequence
  source: /note="Description of Artificial Sequence: Synthetic peptide"
ARSYFYGSSSWYFDV

SEQ ID NO: 1174 - protein, 10 aa, Artificial Sequence
  source: /note="Description of Artificial Sequence: Synthetic peptide"
GYTFTSYNMH

SEQ ID NO: 1175 - protein, 17 aa, Artificial Sequence
  source: /note="Description of Artificial Sequence: Synthetic peptide"
AIYPGNGDTSYNPKFKG

SEQ ID NO: 1176 - protein, 13 aa, Artificial Sequence
  source: /note="Description of Artificial Sequence: Synthetic peptide"
SYFYGSSSWYFDV

SEQ ID NO: 1177 - protein, 122 aa, Artificial Sequence
  source: /note="Description of Artificial Sequence: Synthetic polypeptide"
QVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSS

SEQ ID NO: 1178 - DNA, 366 bp, Artificial Sequence
  source: /note="Description of Artificial Sequence: Synthetic polynucleotide"
caagtgcaactcgtccagtccggtgcagaagtcaagaagcctggttcatcggtgaaagtgtcctgcaaagcgtcgggctacaccttcacctcgtacaacatgcactgggtccgccaggcccccggacaaggactggaatggatgggtgctatctaccccggaaacggagataccagctacaaccccaagttcaagggacgcgtgaccattactgccgacaagtccacaagaaccgcctacatggaactgtccagcctgagatccgaggacactgcggtgtactactgtgcgaggtcctacttctacgggtcctcctcttggtacttcgacgtctggggacagggcactactgtgaccgtgtccagc

SEQ ID NO: 1179 - protein, 10 aa, Artificial Sequence
  source: /note="Description of Artificial Sequence: Synthetic peptide"
RASSSVSSMH

SEQ ID NO: 1180 - protein, 7 aa, Artificial Sequence
  source: /note="Description of Artificial Sequence: Synthetic peptide"
ATSNLAS

SEQ ID NO: 1181 - protein, 9 aa, Artificial Sequence
  source: /note="Description of Artificial Sequence: Synthetic peptide"
QQWIFNPPT

SEQ ID NO: 1182 - protein, 6 aa, Artificial Sequence
  source: /note="Description of Artificial Sequence: Synthetic peptide"
SSSVSS

SEQ ID NO: 1183 - protein, 3 aa, Artificial Sequence
  source: /note="Description of Artificial Sequence: Synthetic peptide"
ATS

SEQ ID NO: 1184 - protein, 6 aa, Artificial Sequence
  source: /note="Description of Artificial Sequence: Synthetic peptide"
WIFNPP

SEQ ID NO: 1185 - protein, 5 aa, Artificial Sequence
  source: /note="Description of Artificial Sequence: Synthetic peptide"
SSVSS

SEQ ID NO: 1186 - protein, 3 aa, Artificial Sequence
  source: /note="Description of Artificial Sequence: Synthetic peptide"
ATS

SEQ ID NO: 1187 - protein, 9 aa, Artificial Sequence
  source: /note="Description of Artificial Sequence: Synthetic peptide"
QQWIFNPPT

SEQ ID NO: 1188 - protein, 10 aa, Artificial Sequence
  source: /note="Description of Artificial Sequence: Synthetic peptide"
RASSSVSSMH

SEQ ID NO: 1189 - protein, 7 aa, Artificial Sequence
  source: /note="Description of Artificial Sequence: Synthetic peptide"
ATSNLAS

SEQ ID NO: 1190 - protein, 9 aa, Artificial Sequence
  source: /note="Description of Artificial Sequence: Synthetic peptide"
QQWIFNPPT

SEQ ID NO: 1191 - protein, 106 aa, Artificial Sequence; identical to SEQ ID NO: 897
  source: /note="Description of Artificial Sequence: Synthetic polypeptide"

SEQ ID NO: 1192 - DNA, 318 bp, Artificial Sequence
  source: /note="Description of Artificial Sequence: Synthetic polynucleotide"
gagatcgtgctgacgcagtcgccggccaccctgagcctttcaccgggagaacgcgccactctgtcatgccgggccagcagctccgtgtcctccatgcattggtaccagcagaagccggggcaggccccgcggcctctcatcttcgccacctccaatctggcctccggcatccctgctcggtttagcggaagcggcagcggaactgactataccttgaccatctcctcgctggaaccagaggatgcagccgtgtactattgccagcagtggatcttcaacccgccaaccttcggcggcggcaccaaggtcgagattaag

SEQ ID NO: 1193 - protein, 20 aa, Artificial Sequence
  source: /note="Description of Artificial Sequence: Synthetic peptide"
GGGGSGGGGSGGGGSGGGGS

SEQ ID NO: 1194 - protein, 248 aa, Artificial Sequence
  source: /note="Description of Artificial Sequence: Synthetic polypeptide"
QVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIK

SEQ ID NO: 1195 - DNA, 744 bp, Artificial Sequence
  source: /note="Description of Artificial Sequence: Synthetic polynucleotide"
caagtgcaactcgtccagtccggtgcagaagtcaagaagcctggttcatcggtgaaagtgtcctgcaaagcgtcgggctacaccttcacctcgtacaacatgcactgggtccgccaggcccccggacaaggactggaatggatgggtgctatctaccccggaaacggagataccagctacaaccccaagttcaagggacgcgtgaccattactgccgacaagtccacaagaaccgcctacatggaactgtccagcctgagatccgaggacactgcggtgtactactgtgcgaggtcctacttctacgggtcctcctcttggtacttcgacgtctggggacagggcactactgtgaccgtgtccagcgggggaggcggtagcggggggggtggatcgggcggcggcggatcaggaggaggagggtccgagatcgtgctgacgcagtcgccggccaccctgagcctttcaccgggagaacgcgccactctgtcatgccgggccagcagctccgtgtcctccatgcattggtaccagcagaagccggggcaggccccgcggcctctcatcttcgccacctccaatctggcctccggcatccctgctcggtttagcggaagcggcagcggaactgactataccttgaccatctcctcgctggaaccagaggatgcagccgtgtactattgccagcagtggatcttcaacccgccaaccttcggcggcggcaccaaggtcgagattaag

SEQ ID NO: 1196 - protein, 492 aa, Artificial Sequence
  source: /note="Description of Artificial Sequence: Synthetic polypeptide"
MALPVTALLLPLALLLHAARPQVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSSGGGGSGGGGSGGGGSGGGGSEIVLTQSPATLSLSPGERATLSCRASSSVSSMHWYQQKPGQAPRPLIFATSNLASGIPARFSGSGSGTDYTLTISSLEPEDAAVYYCQQWIFNPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1197 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtccagtccggtgcagaagtcaagaagcctggttcatcggtgaaagtgtcctgcaaagcgtcgggctacaccttcacctcgtacaacatgcactgggtccgccaggcccccggacaaggactggaatggatgggtgctatctaccccggaaacggagataccagctacaaccccaagttcaagggacgcgtgaccattactgccgacaagtccacaagaaccgcctacatggaactgtccagcctgagatccgaggacactgcggtgtactactgtgcgaggtcctacttctacgggtcctcctcttggtacttcgacgtctggggacagggcactactgtgaccgtgtccagcgggggaggcggtagcggggggggtggatcgggcggcggcggatcaggaggaggagggtccgagatcgtgctgacgcagtcgccggccaccctgagcctttcaccgggagaacgcgccactctgtcatgccgggccagcagctccgtgtcctccatgcattggtaccagcagaagccggggcaggccccgcggcctctcatcttcgccacctccaatctggcctccggcatccctgctcggtttagcggaagcggcagcggaactgactataccttgaccatctcctcgctggaaccagaggatgcagccgtgtactattgccagcagtggatcttcaacccgccaaccttcggcggcggcaccaaggtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1198 - protein, 5 aa, Artificial Sequence
  source: /note="Description of Artificial Sequence: Synthetic peptide"
SYNMH

SEQ ID NO: 1199 - protein, 17 aa, Artificial Sequence
  source: /note="Description of Artificial Sequence: Synthetic peptide"
AIYPGNGDTSYNPKFKG

SEQ ID NO: 1200 - protein, 13 aa, Artificial Sequence
  source: /note="Description of Artificial Sequence: Synthetic peptide"
SYFYGSSSWYFDV

SEQ ID NO: 1201 - protein, 7 aa, Artificial Sequence
  source: /note="Description of Artificial Sequence: Synthetic peptide"
GYTFTSY

SEQ ID NO: 1202 - protein, 6 aa, Artificial Sequence
  source: /note="Description of Artificial Sequence: Synthetic peptide"
YPGNGD

SEQ ID NO: 1203 - protein, 13 aa, Artificial Sequence
  source: /note="Description of Artificial Sequence: Synthetic peptide"
SYFYGSSSWYFDV

SEQ ID NO: 1204 - protein, 8 aa, Artificial Sequence
  source: /note="Description of Artificial Sequence: Synthetic peptide"
GYTFTSYN

SEQ ID NO: 1205 - protein, 8 aa, Artificial Sequence
  source: /note="Description of Artificial Sequence: Synthetic peptide"
IYPGNGDT

SEQ ID NO: 1206 - protein, 15 aa, Artificial Sequence
  source: /note="Description of Artificial Sequence: Synthetic peptide"
ARSYFYGSSSWYFDV

SEQ ID NO: 1207 - protein, 10 aa, Artificial Sequence
  source: /note="Description of Artificial Sequence: Synthetic peptide"
GYTFTSYNMH

SEQ ID NO: 1208 - protein, 17 aa, Artificial Sequence
  source: /note="Description of Artificial Sequence: Synthetic peptide"
AIYPGNGDTSYNPKFKG

SEQ ID NO: 1209 - protein, 13 aa, Artificial Sequence
  source: /note="Description of Artificial Sequence: Synthetic peptide"
SYFYGSSSWYFDV

SEQ ID NO: 1210 - protein, 122 aa, Artificial Sequence; identical to SEQ ID NO: 1177
  source: /note="Description of Artificial Sequence: Synthetic polypeptide"

SEQ ID NO: 1211 - DNA, 366 bp, Artificial Sequence
  source: /note="Description of Artificial Sequence: Synthetic polynucleotide"
caagtgcaactcgtccagtccggtgcagaagtcaagaagccaggttcctcggtgaaagtgtcctgcaaagcctcgggttacaccttcacctcgtacaatatgcactgggtccgccaagctccgggacaaggcctggaatggatgggagcgatctaccccggaaacggcgacacgtcctacaacccgaagttcaagggaagagtgaccatcaccgccgacaagtccacccgcaccgcgtacatggagcttagcagcctgcggagcgaggacactgccgtgtattactgcgcccggtcctacttctatggatcatcctcgtggtacttcgatgtctggggccaggggaccaccgtgaccgtgtccagc

SEQ ID NO: 1212 - protein, 10 aa, Artificial Sequence
  source: /note="Description of Artificial Sequence: Synthetic peptide"
RASSSVSSMH

SEQ ID NO: 1213 - protein, 7 aa, Artificial Sequence
  source: /note="Description of Artificial Sequence: Synthetic peptide"
ATSNLAS

SEQ ID NO: 1214 - protein, 9 aa, Artificial Sequence
  source: /note="Description of Artificial Sequence: Synthetic peptide"
QQWIFNPPT

SEQ ID NO: 1215 - protein, 6 aa, Artificial Sequence
  source: /note="Description of Artificial Sequence: Synthetic peptide"
SSSVSS

SEQ ID NO: 1216 - protein, 3 aa, Artificial Sequence
  source: /note="Description of Artificial Sequence: Synthetic peptide"
ATS

SEQ ID NO: 1217 - protein, 6 aa, Artificial Sequence
  source: /note="Description of Artificial Sequence: Synthetic peptide"
WIFNPP

SEQ ID NO: 1218 - protein, 5 aa, Artificial Sequence
  source: /note="Description of Artificial Sequence: Synthetic peptide"
SSVSS

SEQ ID NO: 1219 - protein, 3 aa, Artificial Sequence
  source: /note="Description of Artificial Sequence: Synthetic peptide"
ATS

SEQ ID NO: 1220 - protein, 9 aa, Artificial Sequence
  source: /note="Description of Artificial Sequence: Synthetic peptide"
QQWIFNPPT

SEQ ID NO: 1221 - protein, 10 aa, Artificial Sequence
  source: /note="Description of Artificial Sequence: Synthetic peptide"
RASSSVSSMH

SEQ ID NO: 1222 - protein, 7 aa, Artificial Sequence
  source: /note="Description of Artificial Sequence: Synthetic peptide"
ATSNLAS

SEQ ID NO: 1223 - protein, 9 aa, Artificial Sequence
  source: /note="Description of Artificial Sequence: Synthetic peptide"
QQWIFNPPT

SEQ ID NO: 1224 - protein, 106 aa, Artificial Sequence; identical to SEQ ID NO: 1158
  source: /note="Description of Artificial Sequence: Synthetic polypeptide"

SEQ ID NO: 1225 - DNA, 318 bp, Artificial Sequence
  source: /note="Description of Artificial Sequence: Synthetic polynucleotide"
gatatccagctgacccagagcccttccttcctgtccgcttccgtgggagacagagtcactattacttgtcgggcctcctcatccgtgtcatccatgcactggtaccagcagaagccgggaaaggccccaaagcccttgatctttgccacttccaacctggcatccggcgtgccctcgaggttctccgggagcggttcagggaccgagtacactctgaccattagcagcctccagcctgaggactttgccacctactactgccagcagtggattttcaacccgcctacattcggagggggcactaaggtcgaaatcaag

SEQ ID NO: 1226 - protein, 20 aa, Artificial Sequence
  source: /note="Description of Artificial Sequence: Synthetic peptide"
GGGGSGGGGSGGGGSGGGGS

SEQ ID NO: 1227 - protein, 248 aa, Artificial Sequence
  source: /note="Description of Artificial Sequence: Synthetic polypeptide"
QVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSSGGGGSGGGGSGGGGSGGGGSDIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIK

SEQ ID NO: 1228 - DNA, 744 bp, Artificial Sequence
  source: /note="Description of Artificial Sequence: Synthetic polynucleotide"
caagtgcaactcgtccagtccggtgcagaagtcaagaagccaggttcctcggtgaaagtgtcctgcaaagcctcgggttacaccttcacctcgtacaatatgcactgggtccgccaagctccgggacaaggcctggaatggatgggagcgatctaccccggaaacggcgacacgtcctacaacccgaagttcaagggaagagtgaccatcaccgccgacaagtccacccgcaccgcgtacatggagcttagcagcctgcggagcgaggacactgccgtgtattactgcgcccggtcctacttctatggatcatcctcgtggtacttcgatgtctggggccaggggaccaccgtgaccgtgtccagcggtggcggaggcagcggcggaggagggtctggaggaggcggctcggggggagggggctcggatatccagctgacccagagcccttccttcctgtccgcttccgtgggagacagagtcactattacttgtcgggcctcctcatccgtgtcatccatgcactggtaccagcagaagccgggaaaggccccaaagcccttgatctttgccacttccaacctggcatccggcgtgccctcgaggttctccgggagcggttcagggaccgagtacactctgaccattagcagcctccagcctgaggactttgccacctactactgccagcagtggattttcaacccgcctacattcggagggggcactaaggtcgaaatcaag

SEQ ID NO: 1229 - protein, 492 aa, Artificial Sequence
  source: /note="Description of Artificial Sequence: Synthetic polypeptide"
MALPVTALLLPLALLLHAARPQVQLVQSGAEVKKPGSSVKVSCKASGYTFTSYNMHWVRQAPGQGLEWMGAIYPGNGDTSYNPKFKGRVTITADKSTRTAYMELSSLRSEDTAVYYCARSYFYGSSSWYFDVWGQGTTVTVSSGGGGSGGGGSGGGGSGGGGSDIQLTQSPSFLSASVGDRVTITCRASSSVSSMHWYQQKPGKAPKPLIFATSNLASGVPSRFSGSGSGTEYTLTISSLQPEDFATYYCQQWIFNPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1230 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtccagtccggtgcagaagtcaagaagccaggttcctcggtgaaagtgtcctgcaaagcctcgggttacaccttcacctcgtacaatatgcactgggtccgccaagctccgggacaaggcctggaatggatgggagcgatctaccccggaaacggcgacacgtcctacaacccgaagttcaagggaagagtgaccatcaccgccgacaagtccacccgcaccgcgtacatggagcttagcagcctgcggagcgaggacactgccgtgtattactgcgcccggtcctacttctatggatcatcctcgtggtacttcgatgtctggggccaggggaccaccgtgaccgtgtccagcggtggcggaggcagcggcggaggagggtctggaggaggcggctcggggggagggggctcggatatccagctgacccagagcccttccttcctgtccgcttccgtgggagacagagtcactattacttgtcgggcctcctcatccgtgtcatccatgcactggtaccagcagaagccgggaaaggccccaaagcccttgatctttgccacttccaacctggcatccggcgtgccctcgaggttctccgggagcggttcagggaccgagtacactctgaccattagcagcctccagcctgaggactttgccacctactactgccagcagtggattttcaacccgcctacattcggagggggcactaaggtcgaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1231 - protein, 5 aa, Artificial Sequence
  source: /note="Description of Artificial Sequence: Synthetic peptide"
RYNMH

SEQ ID NO: 1232 - protein, 17 aa, Artificial Sequence
  source: /note="Description of Artificial Sequence: Synthetic peptide"
AIYPGNGDTSYSQKFKG

SEQ ID NO: 1233 - protein, 13 aa, Artificial Sequence
  source: /note="Description of Artificial Sequence: Synthetic peptide"
SFFYGSSDWYFDV

SEQ ID NO: 1234 - protein, 7 aa, Artificial Sequence
  source: /note="Description of Artificial Sequence: Synthetic peptide"
GYTFTRY

SEQ ID NO: 1235 - protein, 6 aa, Artificial Sequence
  source: /note="Description of Artificial Sequence: Synthetic peptide"
YPGNGD

SEQ ID NO: 1236 - protein, 13 aa, Artificial Sequence
  source: /note="Description of Artificial Sequence: Synthetic peptide"
SFFYGSSDWYFDV

SEQ ID NO: 1237 - protein, 8 aa, Artificial Sequence
  source: /note="Description of Artificial Sequence: Synthetic peptide"
GYTFTRYN

SEQ ID NO: 1238 - protein, 8 aa, Artificial Sequence
  source: /note="Description of Artificial Sequence: Synthetic peptide"
IYPGNGDT

SEQ ID NO: 1239 - protein, 15 aa, Artificial Sequence
  source: /note="Description of Artificial Sequence: Synthetic peptide"
ARSFFYGSSDWYFDV

SEQ ID NO: 1240 - protein, 10 aa, Artificial Sequence
  source: /note="Description of Artificial Sequence: Synthetic peptide"
GYTFTRYNMH

SEQ ID NO: 1241 - protein, 17 aa, Artificial Sequence
  source: /note="Description of Artificial Sequence: Synthetic peptide"
AIYPGNGDTSYSQKFKG

SEQ ID NO: 1242 - protein, 13 aa, Artificial Sequence
  source: /note="Description of Artificial Sequence: Synthetic peptide"
SFFYGSSDWYFDV

SEQ ID NO: 1243 - protein, 122 aa, Artificial Sequence
  source: /note="Description of Artificial Sequence: Synthetic polypeptide"
QVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSS

SEQ ID NO: 1244 - DNA, 366 bp, Artificial Sequence
  source: /note="Description of Artificial Sequence: Synthetic polynucleotide"
caagtccaactcgtccagtcaggagcagaagtcaagaaaccaggagcatccgtgaaagtgtcgtgcaaagcctctggctacaccttcacccggtacaacatgcactgggtcagacaggccccgggacagcggctcgagtggatgggtgccatctaccccggcaacggggacacctcctactcccaaaagttcaagggtcgcgtgaccatcacggcggataagtcggccagcactgcgtacatggaattgtcatccctgcgctccgaggataccgccgtgtattactgcgcgcggtccttcttctacggctcctccgattggtacttcgacgtctggggacagggaactaccgtgaccgtgtcctcc

SEQ ID NO: 1245 - protein, 10 aa, Artificial Sequence
  source: /note="Description of Artificial Sequence: Synthetic peptide"
RASSSVNNMH

SEQ ID NO: 1246 - protein, 7 aa, Artificial Sequence
  source: /note="Description of Artificial Sequence: Synthetic peptide"
ATSNLAS

SEQ ID NO: 1247 - protein, 9 aa, Artificial Sequence
  source: /note="Description of Artificial Sequence: Synthetic peptide"
QQWIFNPPT

SEQ ID NO: 1248 - protein, 6 aa, Artificial Sequence
  source: /note="Description of Artificial Sequence: Synthetic peptide"
SSSVNN

SEQ ID NO: 1249 - protein, 3 aa, Artificial Sequence
  source: /note="Description of Artificial Sequence: Synthetic peptide"
ATS

SEQ ID NO: 1250 - protein, 6 aa, Artificial Sequence
  source: /note="Description of Artificial Sequence: Synthetic peptide"
WIFNPP

SEQ ID NO: 1251 - protein, 5 aa, Artificial Sequence
  source: /note="Description of Artificial Sequence: Synthetic peptide"
SSVNN

SEQ ID NO: 1252 - protein, 3 aa, Artificial Sequence
  source: /note="Description of Artificial Sequence: Synthetic peptide"
ATS

SEQ ID NO: 1253 - protein, 9 aa, Artificial Sequence
  source: /note="Description of Artificial Sequence: Synthetic peptide"
QQWIFNPPT

SEQ ID NO: 1254 - protein, 10 aa, Artificial Sequence
  source: /note="Description of Artificial Sequence: Synthetic peptide"
RASSSVNNMH

SEQ ID NO: 1255 - protein, 7 aa, Artificial Sequence
  source: /note="Description of Artificial Sequence: Synthetic peptide"
ATSNLAS

SEQ ID NO: 1256 - protein, 9 aa, Artificial Sequence
  source: /note="Description of Artificial Sequence: Synthetic peptide"
QQWIFNPPT

SEQ ID NO: 1257 - protein, 106 aa, Artificial Sequence
  source: /note="Description of Artificial Sequence: Synthetic polypeptide"
EIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIK

SEQ ID NO: 1258 - DNA, 318 bp, Artificial Sequence
  source: /note="Description of Artificial Sequence: Synthetic polynucleotide"
gaaatcgtgctgactcagtcgccggacttccaaagcgtgaccccaaaggagaaggtcaccatcacctgtagagcctcatcgtccgtgaacaatatgcactggtaccagcagaagccggaccagtcccctaagcccctgatctacgccacttccaacctggcctccggcgtgccgtcgaggttcagcggctcgggcagcgggaccgactacaccctgaccatcaacagccttgaagctgaggacgccgctacctactactgccagcagtggattttcaaccctcccacatttggacagggcactaagctggagattaag

SEQ ID NO: 1259 - protein, 20 aa, Artificial Sequence
  source: /note="Description of Artificial Sequence: Synthetic peptide"
GGGGSGGGGSGGGGSGGGGS

SEQ ID NO: 1260 - protein, 248 aa, Artificial Sequence
  source: /note="Description of Artificial Sequence: Synthetic polypeptide"
QVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSSGGGGSGGGGSGGGGSGGGGSEIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIK

SEQ ID NO: 1261 - DNA, 744 bp, Artificial Sequence
  source: /note="Description of Artificial Sequence: Synthetic polynucleotide"
caagtccaactcgtccagtcaggagcagaagtcaagaaaccaggagcatccgtgaaagtgtcgtgcaaagcctctggctacaccttcacccggtacaacatgcactgggtcagacaggccccgggacagcggctcgagtggatgggtgccatctaccccggcaacggggacacctcctactcccaaaagttcaagggtcgcgtgaccatcacggcggataagtcggccagcactgcgtacatggaattgtcatccctgcgctccgaggataccgccgtgtattactgcgcgcggtccttcttctacggctcctccgattggtacttcgacgtctggggacagggaactaccgtgaccgtgtcctccgggggtggcgggagcggagggggcggaagcgggggtggaggatcaggaggcggaggctccgaaatcgtgctgactcagtcgccggacttccaaagcgtgaccccaaaggagaaggtcaccatcacctgtagagcctcatcgtccgtgaacaatatgcactggtaccagcagaagccggaccagtcccctaagcccctgatctacgccacttccaacctggcctccggcgtgccgtcgaggttcagcggctcgggcagcgggaccgactacaccctgaccatcaacagccttgaagctgaggacgccgctacctactactgccagcagtggattttcaaccctcccacatttggacagggcactaagctggagattaag

SEQ ID NO: 1262 - protein, 492 aa, Artificial Sequence
  source: /note="Description of Artificial Sequence: Synthetic polypeptide"
MALPVTALLLPLALLLHAARPQVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSSGGGGSGGGGSGGGGSGGGGSEIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1263 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtcaggagcagaagtcaagaaaccaggagcatccgtgaaagtgtcgtgcaaagcctctggctacaccttcacccggtacaacatgcactgggtcagacaggccccgggacagcggctcgagtggatgggtgccatctaccccggcaacggggacacctcctactcccaaaagttcaagggtcgcgtgaccatcacggcggataagtcggccagcactgcgtacatggaattgtcatccctgcgctccgaggataccgccgtgtattactgcgcgcggtccttcttctacggctcctccgattggtacttcgacgtctggggacagggaactaccgtgaccgtgtcctccgggggtggcgggagcggagggggcggaagcgggggtggaggatcaggaggcggaggctccgaaatcgtgctgactcagtcgccggacttccaaagcgtgaccccaaaggagaaggtcaccatcacctgtagagcctcatcgtccgtgaacaatatgcactggtaccagcagaagccggaccagtcccctaagcccctgatctacgccacttccaacctggcctccggcgtgccgtcgaggttcagcggctcgggcagcgggaccgactacaccctgaccatcaacagccttgaagctgaggacgccgctacctactactgccagcagtggattttcaaccctcccacatttggacagggcactaagctggagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1264 - protein, 5 aa, Artificial Sequence
  source: /note="Description of Artificial Sequence: Synthetic peptide"
RYNMH

SEQ ID NO: 1265 - protein, 17 aa, Artificial Sequence
  source: /note="Description of Artificial Sequence: Synthetic peptide"
AIYPGNGDTSYSQKFKG

SEQ ID NO: 1266 - protein, 13 aa, Artificial Sequence
  source: /note="Description of Artificial Sequence: Synthetic peptide"
SFFYGSSDWYFDV

SEQ ID NO: 1267 - protein, 7 aa, Artificial Sequence
  source: /note="Description of Artificial Sequence: Synthetic peptide"
GYTFTRY

SEQ ID NO: 1268 - protein, 6 aa, Artificial Sequence
  source: /note="Description of Artificial Sequence: Synthetic peptide"
YPGNGD

SEQ ID NO: 1269 - protein, 13 aa, Artificial Sequence
  source: /note="Description of Artificial Sequence: Synthetic peptide"
SFFYGSSDWYFDV

SEQ ID NO: 1270 - protein, 8 aa, Artificial Sequence
  source: /note="Description of Artificial Sequence: Synthetic peptide"
GYTFTRYN

SEQ ID NO: 1271 - protein, 8 aa, Artificial Sequence
  source: /note="Description of Artificial Sequence: Synthetic peptide"
IYPGNGDT

SEQ ID NO: 1272 - protein, 15 aa, Artificial Sequence
  source: /note="Description of Artificial Sequence: Synthetic peptide"
ARSFFYGSSDWYFDV

SEQ ID NO: 1273 - protein, 10 aa, Artificial Sequence
  source: /note="Description of Artificial Sequence: Synthetic peptide"
GYTFTRYNMH

SEQ ID NO: 1274 - protein, 17 aa, Artificial Sequence
  source: /note="Description of Artificial Sequence: Synthetic peptide"
AIYPGNGDTSYSQKFKG

SEQ ID NO: 1275 - protein, 13 aa, Artificial Sequence
  source: /note="Description of Artificial Sequence: Synthetic peptide"
SFFYGSSDWYFDV

SEQ ID NO: 1276 - protein, 122 aa, Artificial Sequence; identical to SEQ ID NO: 1243
  source: /note="Description of Artificial Sequence: Synthetic polypeptide"

SEQ ID NO: 1277 - DNA, 366 bp, Artificial Sequence
  source: /note="Description of Artificial Sequence: Synthetic polynucleotide"
caagtgcaactcgtccaatccggcgcggaagtcaaaaagcctggagcctccgtcaaagtgtcctgcaaggcctccggttacactttcactcgctacaacatgcattgggtgcggcaggccccgggacagcgcctggaatggatgggcgcaatctaccccggcaacggagacacctcctattcccaaaagttcaagggaagggtcacaatcacggccgacaagagcgcctcaactgcctacatggagctgagcagcctcagatccgaagataccgcggtgtactactgcgcccggagcttcttctacggttcgtctgattggtactttgacgtctggggccagggaaccaccgtgaccgtgtcgtcc

SEQ ID NO: 1278 - protein, 10 aa, Artificial Sequence
  source: /note="Description of Artificial Sequence: Synthetic peptide"
RASSSVNNMH

SEQ ID NO: 1279 - protein, 7 aa, Artificial Sequence
  source: /note="Description of Artificial Sequence: Synthetic peptide"
ATSNLAS

SEQ ID NO: 1280 - protein, 9 aa, Artificial Sequence
  source: /note="Description of Artificial Sequence: Synthetic peptide"
QQWIFNPPT

SEQ ID NO: 1281 - protein, 6 aa, Artificial Sequence
  source: /note="Description of Artificial Sequence: Synthetic peptide"
SSSVNN

SEQ ID NO: 1282 - protein, 3 aa, Artificial Sequence
  source: /note="Description of Artificial Sequence: Synthetic peptide"
ATS

SEQ ID NO: 1283 - protein, 6 aa, Artificial Sequence
  source: /note="Description of Artificial Sequence: Synthetic peptide"
WIFNPP

SEQ ID NO: 1284 - protein, 5 aa, Artificial Sequence
  source: /note="Description of Artificial Sequence: Synthetic peptide"
SSVNN

SEQ ID NO: 1285 - protein, 3 aa, Artificial Sequence
  source: /note="Description of Artificial Sequence: Synthetic peptide"
ATS

SEQ ID NO: 1286 - protein, 9 aa, Artificial Sequence
  source: /note="Description of Artificial Sequence: Synthetic peptide"
QQWIFNPPT

SEQ ID NO: 1287 - protein, 10 aa, Artificial Sequence
  source: /note="Description of Artificial Sequence: Synthetic peptide"
RASSSVNNMH

SEQ ID NO: 1288 - protein, 7 aa, Artificial Sequence
  source: /note="Description of Artificial Sequence: Synthetic peptide"
ATSNLAS

SEQ ID NO: 1289 - protein, 9 aa, Artificial Sequence
  source: /note="Description of Artificial Sequence: Synthetic peptide"
QQWIFNPPT

SEQ ID NO: 1290 - protein, 106 aa, Artificial Sequence
  source: /note="Description of Artificial Sequence: Synthetic polypeptide"
DIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIK

SEQ ID NO: 1291 - DNA, 318 bp, Artificial Sequence
  source: /note="Description of Artificial Sequence: Synthetic polynucleotide"
gacatccagcttacccagtcgccatcattcctgtccgcatcagtgggtgatcgcgtgaccattacctgtcgggcgtcctcctccgtgaacaacatgcactggtaccagcagaagccggggaaggctcccaagcctctgatctacgccactagcaatttggccagcggcgtgccttcgagattctcggggtcgggctcaggaaccgagtataccctgaccatttcctccctccaaccggaggactttgctacttactactgccagcagtggattttcaaccccccgactttcggacagggcaccaagctggaaatcaag

SEQ ID NO: 1292 - protein, 20 aa, Artificial Sequence
  source: /note="Description of Artificial Sequence: Synthetic peptide"
GGGGSGGGGSGGGGSGGGGS

SEQ ID NO: 1293 - protein, 248 aa, Artificial Sequence
  source: /note="Description of Artificial Sequence: Synthetic polypeptide"
QVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSSGGGGSGGGGSGGGGSGGGGSDIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIK

SEQ ID NO: 1294 - DNA, 744 bp, Artificial Sequence
  source: /note="Description of Artificial Sequence: Synthetic polynucleotide"
caagtgcaactcgtccaatccggcgcggaagtcaaaaagcctggagcctccgtcaaagtgtcctgcaaggcctccggttacactttcactcgctacaacatgcattgggtgcggcaggccccgggacagcgcctggaatggatgggcgcaatctaccccggcaacggagacacctcctattcccaaaagttcaagggaagggtcacaatcacggccgacaagagcgcctcaactgcctacatggagctgagcagcctcagatccgaagataccgcggtgtactactgcgcccggagcttcttctacggttcgtctgattggtactttgacgtctggggccagggaaccaccgtgaccgtgtcgtccggtggcggagggagcggtggaggaggctccgggggaggaggcagcggcgggggaggcagcgacatccagcttacccagtcgccatcattcctgtccgcatcagtgggtgatcgcgtgaccattacctgtcgggcgtcctcctccgtgaacaacatgcactggtaccagcagaagccggggaaggctcccaagcctctgatctacgccactagcaatttggccagcggcgtgccttcgagattctcggggtcgggctcaggaaccgagtataccctgaccatttcctccctccaaccggaggactttgctacttactactgccagcagtggattttcaaccccccgactttcggacagggcaccaagctggaaatcaag

SEQ ID NO: 1295 - protein, 492 aa, Artificial Sequence
  source: /note="Description of Artificial Sequence: Synthetic polypeptide"
MALPVTALLLPLALLLHAARPQVQLVQSGAEVKKPGASVKVSCKASGYTFTRYNMHWVRQAPGQRLEWMGAIYPGNGDTSYSQKFKGRVTITADKSASTAYMELSSLRSEDTAVYYCARSFFYGSSDWYFDVWGQGTTVTVSSGGGGSGGGGSGGGGSGGGGSDIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1296 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtccaatccggcgcggaagtcaaaaagcctggagcctccgtcaaagtgtcctgcaaggcctccggttacactttcactcgctacaacatgcattgggtgcggcaggccccgggacagcgcctggaatggatgggcgcaatctaccccggcaacggagacacctcctattcccaaaagttcaagggaagggtcacaatcacggccgacaagagcgcctcaactgcctacatggagctgagcagcctcagatccgaagataccgcggtgtactactgcgcccggagcttcttctacggttcgtctgattggtactttgacgtctggggccagggaaccaccgtgaccgtgtcgtccggtggcggagggagcggtggaggaggctccgggggaggaggcagcggcgggggaggcagcgacatccagcttacccagtcgccatcattcctgtccgcatcagtgggtgatcgcgtgaccattacctgtcgggcgtcctcctccgtgaacaacatgcactggtaccagcagaagccggggaaggctcccaagcctctgatctacgccactagcaatttggccagcggcgtgccttcgagattctcggggtcgggctcaggaaccgagtataccctgaccatttcctccctccaaccggaggactttgctacttactactgccagcagtggattttcaaccccccgactttcggacagggcaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1297 - protein, 5 aa, Artificial Sequence
  source: /note="Description of Artificial Sequence: Synthetic peptide"
RYNMH

SEQ ID NO: 1298 - protein, 17 aa, Artificial Sequence
  source: /note="Description of Artificial Sequence: Synthetic peptide"
AIYPGNGDTSYSQKFKG

SEQ ID NO: 1299 - protein, 13 aa, Artificial Sequence
  source: /note="Description of Artificial Sequence: Synthetic peptide"
SFFYGSSDWYFDV

SEQ ID NO: 1300 - protein, 7 aa, Artificial Sequence
  source: /note="Description of Artificial Sequence: Synthetic peptide"
GYTFTRY

SEQ ID NO: 1301 - protein, 6 aa, Artificial Sequence
  source: /note="Description of Artificial Sequence: Synthetic peptide"
YPGNGD

SEQ ID NO: 1302 - protein, 13 aa, Artificial Sequence
  source: /note="Description of Artificial Sequence: Synthetic peptide"
SFFYGSSDWYFDV

SEQ ID NO: 1303 - protein, 8 aa, Artificial Sequence
  source: /note="Description of Artificial Sequence: Synthetic peptide"
GYTFTRYN

SEQ ID NO: 1304 - protein, 8 aa, Artificial Sequence
  source: /note="Description of Artificial Sequence: Synthetic peptide"
IYPGNGDT

SEQ ID NO: 1305 - protein, 15 aa, Artificial Sequence
  source: /note="Description of Artificial Sequence: Synthetic peptide"
ARSFFYGSSDWYFDV

SEQ ID NO: 1306 - protein, 10 aa, Artificial Sequence
  source: /note="Description of Artificial Sequence: Synthetic peptide"
GYTFTRYNMH

SEQ ID NO: 1307 - protein, 17 aa, Artificial Sequence
  source: /note="Description of Artificial Sequence: Synthetic peptide"
AIYPGNGDTSYSQKFKG

SEQ ID NO: 1308 - protein, 13 aa, Artificial Sequence
  source: /note="Description of Artificial Sequence: Synthetic peptide"
SFFYGSSDWYFDV

SEQ ID NO: 1309 - protein, 122 aa, Artificial Sequence
  source: /note="Description of Artificial Sequence: Synthetic polypeptide"
QVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSS

SEQ ID NO: 1310 - DNA, 366 bp, Artificial Sequence
  source: /note="Description of Artificial Sequence: Synthetic polynucleotide"
caagtgcaactcgtccagtccggtgcagaagtcaagaagcctggttcctccgtgaaagtgtcctgcaaagcgtctggctacaccttcacccggtacaatatgcactgggtcagacaggcgcccggacagggcctggagtggatgggggccatctaccctgggaacggcgacactagctactcccaaaagttcaagggccgcgtgacgattaccgccgacaagtcaaccagcactgcctatatggagctgagctcgcttcggagcgaagataccgccgtgtactactgcgctcggagcttcttctacgggtcctcggattggtacttcgacgtctggggccaggggactactgtgaccgtgtcctcc

SEQ ID NO: 1311 - protein, 10 aa, Artificial Sequence
  source: /note="Description of Artificial Sequence: Synthetic peptide"
RASSSVNNMH

SEQ ID NO: 1312 - protein, 7 aa, Artificial Sequence
  source: /note="Description of Artificial Sequence: Synthetic peptide"
ATSNLAS

SEQ ID NO: 1313 - protein, 9 aa, Artificial Sequence
  source: /note="Description of Artificial Sequence: Synthetic peptide"
QQWIFNPPT

SEQ ID NO: 1314 - protein, 6 aa, Artificial Sequence
  source: /note="Description of Artificial Sequence: Synthetic peptide"
SSSVNN

SEQ ID NO: 1315 - protein, 3 aa, Artificial Sequence
  source: /note="Description of Artificial Sequence: Synthetic peptide"
ATS

SEQ ID NO: 1316 - protein, 6 aa, Artificial Sequence
  source: /note="Description of Artificial Sequence: Synthetic peptide"
WIFNPP

SEQ ID NO: 1317 - protein, 5 aa, Artificial Sequence
  source: /note="Description of Artificial Sequence: Synthetic peptide"
SSVNN

SEQ ID NO: 1318 - protein, 3 aa, Artificial Sequence
  source: /note="Description of Artificial Sequence: Synthetic peptide"
ATS

SEQ ID NO: 1319 - protein, 9 aa, Artificial Sequence
  source: /note="Description of Artificial Sequence: Synthetic peptide"
QQWIFNPPT

SEQ ID NO: 1320 - protein, 10 aa, Artificial Sequence
  source: /note="Description of Artificial Sequence: Synthetic peptide"
RASSSVNNMH

SEQ ID NO: 1321 - protein, 7 aa, Artificial Sequence
  source: /note="Description of Artificial Sequence: Synthetic peptide"
ATSNLAS

SEQ ID NO: 1322 - protein, 9 aa, Artificial Sequence
  source: /note="Description of Artificial Sequence: Synthetic peptide"
QQWIFNPPT

SEQ ID NO: 1323 - protein, 106 aa, Artificial Sequence; identical to SEQ ID NO: 1257
  source: /note="Description of Artificial Sequence: Synthetic polypeptide"

SEQ ID NO: 1324 - DNA, 318 bp, Artificial Sequence
  source: /note="Description of Artificial Sequence: Synthetic polynucleotide"
gaaatcgtgctgacccagtccccggactttcagtcagtgactcccaaggagaaggtcaccattacttgtcgcgcctcctcctcggtgaacaacatgcactggtaccagcagaagccggaccagtccccgaagcccctgatctatgctacctccaacttggcgtccggcgtgccgtcaaggttcagcggatcgggttccgggacagactacaccctgactattaactcactcgaggccgaggatgccgccacctactactgccagcagtggatcttcaaccctccaaccttcggacaaggaaccaagctggaaatcaag

SEQ ID NO: 1325 - protein, 20 aa, Artificial Sequence
  source: /note="Description of Artificial Sequence: Synthetic peptide"
GGGGSGGGGSGGGGSGGGGS

SEQ ID NO: 1326 - protein, 248 aa, Artificial Sequence
  source: /note="Description of Artificial Sequence: Synthetic polypeptide"
QVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSSGGGGSGGGGSGGGGSGGGGSEIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIK

SEQ ID NO: 1327 - DNA, 744 bp, Artificial Sequence
  source: /note="Description of Artificial Sequence: Synthetic polynucleotide"
caagtgcaactcgtccagtccggtgcagaagtcaagaagcctggttcctccgtgaaagtgtcctgcaaagcgtctggctacaccttcacccggtacaatatgcactgggtcagacaggcgcccggacagggcctggagtggatgggggccatctaccctgggaacggcgacactagctactcccaaaagttcaagggccgcgtgacgattaccgccgacaagtcaaccagcactgcctatatggagctgagctcgcttcggagcgaagataccgccgtgtactactgcgctcggagcttcttctacgggtcctcggattggtacttcgacgtctggggccaggggactactgtgaccgtgtcctccgggggaggaggatcgggcggaggcggttcgggaggcggcggaagcggaggcggaggttcagaaatcgtgctgacccagtccccggactttcagtcagtgactcccaaggagaaggtcaccattacttgtcgcgcctcctcctcggtgaacaacatgcactggtaccagcagaagccggaccagtccccgaagcccctgatctatgctacctccaacttggcgtccggcgtgccgtcaaggttcagcggatcgggttccgggacagactacaccctgactattaactcactcgaggccgaggatgccgccacctactactgccagcagtggatcttcaaccctccaaccttcggacaaggaaccaagctggaaatcaag

SEQ ID NO: 1328 - protein, 492 aa, Artificial Sequence
  source: /note="Description of Artificial Sequence: Synthetic polypeptide"
MALPVTALLLPLALLLHAARPQVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSSGGGGSGGGGSGGGGSGGGGSEIVLTQSPDFQSVTPKEKVTITCRASSSVNNMHWYQQKPDQSPKPLIYATSNLASGVPSRFSGSGSGTDYTLTINSLEAEDAATYYCQQWIFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1329 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtgcaactcgtccagtccggtgcagaagtcaagaagcctggttcctccgtgaaagtgtcctgcaaagcgtctggctacaccttcacccggtacaatatgcactgggtcagacaggcgcccggacagggcctggagtggatgggggccatctaccctgggaacggcgacactagctactcccaaaagttcaagggccgcgtgacgattaccgccgacaagtcaaccagcactgcctatatggagctgagctcgcttcggagcgaagataccgccgtgtactactgcgctcggagcttcttctacgggtcctcggattggtacttcgacgtctggggccaggggactactgtgaccgtgtcctccgggggaggaggatcgggcggaggcggttcgggaggcggcggaagcggaggcggaggttcagaaatcgtgctgacccagtccccggactttcagtcagtgactcccaaggagaaggtcaccattacttgtcgcgcctcctcctcggtgaacaacatgcactggtaccagcagaagccggaccagtccccgaagcccctgatctatgctacctccaacttggcgtccggcgtgccgtcaaggttcagcggatcgggttccgggacagactacaccctgactattaactcactcgaggccgaggatgccgccacctactactgccagcagtggatcttcaaccctccaaccttcggacaaggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1330 - protein, 5 aa, Artificial Sequence
  source: /note="Description of Artificial Sequence: Synthetic peptide"
RYNMH

SEQ ID NO: 1331 - protein, 17 aa, Artificial Sequence
  source: /note="Description of Artificial Sequence: Synthetic peptide"
AIYPGNGDTSYSQKFKG

SEQ ID NO: 1332 - protein, 13 aa, Artificial Sequence
  source: /note="Description of Artificial Sequence: Synthetic peptide"
SFFYGSSDWYFDV

SEQ ID NO: 1333 - protein, 7 aa, Artificial Sequence
  source: /note="Description of Artificial Sequence: Synthetic peptide"
GYTFTRY

SEQ ID NO: 1334 - protein, 6 aa, Artificial Sequence
  source: /note="Description of Artificial Sequence: Synthetic peptide"
YPGNGD

SEQ ID NO: 1335 - protein, 13 aa, Artificial Sequence
  source: /note="Description of Artificial Sequence: Synthetic peptide"
SFFYGSSDWYFDV

SEQ ID NO: 1336 - protein, 8 aa, Artificial Sequence
  source: /note="Description of Artificial Sequence: Synthetic peptide"
GYTFTRYN

SEQ ID NO: 1337 - protein, 8 aa, Artificial Sequence
  source: /note="Description of Artificial Sequence: Synthetic peptide"
IYPGNGDT

SEQ ID NO: 1338 - protein, 15 aa, Artificial Sequence
  source: /note="Description of Artificial Sequence: Synthetic peptide"
ARSFFYGSSDWYFDV

SEQ ID NO: 1339 - protein, 10 aa, Artificial Sequence
  source: /note="Description of Artificial Sequence: Synthetic peptide"
GYTFTRYNMH

SEQ ID NO: 1340 - protein, 17 aa, Artificial Sequence
  source: /note="Description of Artificial Sequence: Synthetic peptide"
AIYPGNGDTSYSQKFKG

SEQ ID NO: 1341 - protein, 13 aa, Artificial Sequence
  source: /note="Description of Artificial Sequence: Synthetic peptide"
SFFYGSSDWYFDV

SEQ ID NO: 1342 - protein, 122 aa, Artificial Sequence; identical to SEQ ID NO: 1309
  source: /note="Description of Artificial Sequence: Synthetic polypeptide"

SEQ ID NO: 1343 - DNA, 366 bp, Artificial Sequence
  source: /note="Description of Artificial Sequence: Synthetic polynucleotide"
caagtccaactcgtccagtctggcgcagaagtcaagaagcccggaagctccgtgaaagtgtcctgcaaagcgtcgggttacactttcacccggtacaacatgcactgggtcagacaggcccctggacaaggactggagtggatgggtgccatctaccctggaaacggagatacctcctactcccaaaagttcaaggggagagtgaccattaccgccgacaagtcaacttccaccgcttacatggagctcagctccctgcggtccgaagatactgcggtgtactattgcgctcgctcatttttctacggctcatcggattggtacttcgacgtctggggacagggaactaccgtgaccgtgtcctcg

SEQ ID NO: 1344 - protein, 10 aa, Artificial Sequence
  source: /note="Description of Artificial Sequence: Synthetic peptide"
RASSSVNNMH

SEQ ID NO: 1345 - protein, 7 aa, Artificial Sequence
  source: /note="Description of Artificial Sequence: Synthetic peptide"
ATSNLAS

SEQ ID NO: 1346 - protein, 9 aa, Artificial Sequence
  source: /note="Description of Artificial Sequence: Synthetic peptide"
QQWIFNPPT

SEQ ID NO: 1347 - protein, 6 aa, Artificial Sequence
  source: /note="Description of Artificial Sequence: Synthetic peptide"
SSSVNN

SEQ ID NO: 1348 - protein, 3 aa, Artificial Sequence
  source: /note="Description of Artificial Sequence: Synthetic peptide"
ATS

SEQ ID NO: 1349 - protein, 6 aa, Artificial Sequence
  source: /note="Description of Artificial Sequence: Synthetic peptide"
WIFNPP

SEQ ID NO: 1350 - protein, 5 aa, Artificial Sequence
  source: /note="Description of Artificial Sequence: Synthetic peptide"
SSVNN

SEQ ID NO: 1351 - protein, 3 aa, Artificial Sequence
  source: /note="Description of Artificial Sequence: Synthetic peptide"
ATS

SEQ ID NO: 1352 - protein, 9 aa, Artificial Sequence
  source: /note="Description of Artificial Sequence: Synthetic peptide"
QQWIFNPPT

SEQ ID NO: 1353 - protein, 10 aa, Artificial Sequence
  source: /note="Description of Artificial Sequence: Synthetic peptide"
RASSSVNNMH

SEQ ID NO: 1354 - protein, 7 aa, Artificial Sequence
  source: /note="Description of Artificial Sequence: Synthetic peptide"
ATSNLAS

SEQ ID NO: 1355 - protein, 9 aa, Artificial Sequence
  source: /note="Description of Artificial Sequence: Synthetic peptide"
QQWIFNPPT

SEQ ID NO: 1356 - protein, 106 aa, Artificial Sequence; identical to SEQ ID NO: 1290
  source: /note="Description of Artificial Sequence: Synthetic polypeptide"

SEQ ID NO: 1357 - DNA, 318 bp, Artificial Sequence
  source: /note="Description of Artificial Sequence: Synthetic polynucleotide"
gacatccagctgactcagtccccgtccttcctgtccgcctccgtgggggaccgcgtgacgattacttgtcgggcctcctcatccgtgaacaacatgcattggtaccagcagaagccaggaaaggcaccgaagccgcttatctatgccacctcgaatctggccagcggagtgccttcgaggtttagcggctccggctccggcaccgagtacactttgaccattagcagcctccagccggaggacttcgccacatactactgccagcagtggatcttcaacccccccaccttcggccaaggaaccaagctggaaatcaag

SEQ ID NO: 1358 - protein, 20 aa, Artificial Sequence
  source: /note="Description of Artificial Sequence: Synthetic peptide"
GGGGSGGGGSGGGGSGGGGS

SEQ ID NO: 1359 - protein, 248 aa, Artificial Sequence
  source: /note="Description of Artificial Sequence: Synthetic polypeptide"
QVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSSGGGGSGGGGSGGGGSGGGGSDIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIK

SEQ ID NO: 1360 - DNA, 744 bp, Artificial Sequence
  source: /note="Description of Artificial Sequence: Synthetic polynucleotide"
caagtccaactcgtccagtctggcgcagaagtcaagaagcccggaagctccgtgaaagtgtcctgcaaagcgtcgggttacactttcacccggtacaacatgcactgggtcagacaggcccctggacaaggactggagtggatgggtgccatctaccctggaaacggagatacctcctactcccaaaagttcaaggggagagtgaccattaccgccgacaagtcaacttccaccgcttacatggagctcagctccctgcggtccgaagatactgcggtgtactattgcgctcgctcatttttctacggctcatcggattggtacttcgacgtctggggacagggaactaccgtgaccgtgtcctcggggggaggaggatcgggcggaggcggttcgggaggcggcggaagcggaggcggaggttcagacatccagctgactcagtccccgtccttcctgtccgcctccgtgggggaccgcgtgacgattacttgtcgggcctcctcatccgtgaacaacatgcattggtaccagcagaagccaggaaaggcaccgaagccgcttatctatgccacctcgaatctggccagcggagtgccttcgaggtttagcggctccggctccggcaccgagtacactttgaccattagcagcctccagccggaggacttcgccacatactactgccagcagtggatcttcaacccccccaccttcggccaaggaaccaagctggaaatcaag

SEQ ID NO: 1361 - protein, 492 aa, Artificial Sequence
  source: /note="Description of Artificial Sequence: Synthetic polypeptide"
MALPVTALLLPLALLLHAARPQVQLVQSGAEVKKPGSSVKVSCKASGYTFTRYNMHWVRQAPGQGLEWMGAIYPGNGDTSYSQKFKGRVTITADKSTSTAYMELSSLRSEDTAVYYCARSFFYGSSDWYFDVWGQGTTVTVSSGGGGSGGGGSGGGGSGGGGSDIQLTQSPSFLSASVGDRVTITCRASSSVNNMHWYQQKPGKAPKPLIYATSNLASGVPSRFSGSGSGTEYTLTISSLQPEDFATYYCQQWIFNPPTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1362 - DNA, 1476 bp, Artificial Sequence
  source: /note="Description of Artificial Sequence: Synthetic polynucleotide"
atggccctccctgtcaccgccctgctgcttccgctggctcttctgctccacgccgctcggccccaagtccaactcgtccagtctggcgcagaagtcaagaagcccggaagctccgtgaaagtgtcctgcaaagcgtcgggttacactttcacccggtacaacatgcactgggtcagacaggcccctggacaaggactggagtggatgggtgccatctaccctggaaacggagatacctcctactcccaaaagttcaaggggagagtgaccattaccgccgacaagtcaacttccaccgcttacatggagctcagctccctgcggtccgaagatactgcggtgtactattgcgctcgctcatttttctacggctcatcggattggtacttcgacgtctggggacagggaactaccgtgaccgtgtcctcggggggaggggggagcggcggagggggctcgggcggtggaggaagcggaggcggcggttcggacatccagctgactcagtccccgtccttcctgtccgcctccgtgggggaccgcgtgacgattacttgtcgggcctcctcatccgtgaacaacatgcattggtaccagcagaagccaggaaaggcaccgaagccgcttatctatgccacctcgaatctggccagcggagtgccttcgaggtttagcggctccggctccggcaccgagtacactttgaccattagcagcctccagccggaggacttcgccacatactactgccagcagtggatcttcaacccccccaccttcggccaaggaaccaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctaccagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1363 - protein, 122 aa, Artificial Sequence
  source: /note="Description of Artificial Sequence: Synthetic polypeptide"
QVHLQQSGAELAKPGASVKMSCKASGYTFTNYWMHWVKQRPGQGLEWIGFITPTTGYPEYNQKFKDKATLTADKSSSTAYMQLSSLTSEDSAVYYCARRKVGKGVYYALDYWGQGTSVTVSS

SEQ ID NO: 1364 - DNA, 366 bp, Artificial Sequence
  source: /note="Description of Artificial Sequence: Synthetic polynucleotide"
caagtgcatctgcagcagtcgggggccgaactggcaaagccaggcgccagcgtgaagatgagctgcaaggcctccgggtacaccttcaccaactactggatgcactgggtcaagcagcgcccgggccagggactcgagtggatcgggttcatcacgccgactaccggctacccggagtataaccagaagttcaaggacaaggccactctgactgccgacaagtcctcgtctaccgcgtacatgcaactgtcctcactgacttcggaggattccgctgtgtactactgcgcgcggaggaaagtcggaaagggagtgtactatgccctggactactggggccagggtaccagcgtcactgtgtcctcc

SEQ ID NO: 1365 - protein, 107 aa, Artificial Sequence
  source: /note="Description of Artificial Sequence: Synthetic polypeptide"
DILMTQSPASLSASVGETVTITCRASGNIHNYLAWYQQKQGNSPQLLVYNTKTLADGVPSRFSGSGSGTQYSLKINSLQTEDFGTYYCQHFWSSPWTFGGGTKLEIK

SEQ ID NO: 1366 - DNA, 321 bp, Artificial Sequence
  source: /note="Description of Artificial Sequence: Synthetic polynucleotide"
gacattctgatgacccagtcccctgcatcactctccgcgtccgtgggagaaaccgtgaccatcacgtgtagagcctccggcaacatccacaactacctggcctggtaccagcagaagcagggaaactcgccccaactgcttgtgtacaacaccaagaccttggctgacggagtgccttcccggttctcgggttcgggatcaggcacacagtactccctgaaaatcaatagcctccagaccgaagattttggaacctactactgccaacacttctggagctccccctggactttcggaggcggtaccaagctcgagattaag

SEQ ID NO: 1367 - protein, 122 aa, Artificial Sequence
  source: /note="Description of Artificial Sequence: Synthetic polypeptide"
QVQLQQPGAELVKPGASVKMSCKASGYTFTNYNLHWVKQTPGQGLEWIGAIYPGNYDTSYNQKFKGKATLTADKSSSTAYMLLSSLTSEDSAVYFCARVDFGHSRYWYFDVWGAGTTVTVSS

SEQ ID NO: 1368 - DNA, 366 bp, Artificial Sequence
  source: /note="Description of Artificial Sequence: Synthetic polynucleotide"
caagtgcagctgcagcagcctggtgccgagctcgtgaagccgggagcgtccgtgaagatgagctgcaaagcctcgggctacaccttcaccaattacaacttgcattgggtcaagcagaccccgggccagggcctcgaatggatcggagcgatctaccccgggaactacgatactagctacaaccagaagttcaagggaaaggccaccctgaccgccgataagtcctcatccaccgcctacatgctgctgtcctcgctgacttccgaggactccgctgtgtacttctgcgcccgcgtggacttcggacacagcagatattggtattttgacgtctggggcgccgggactaccgtgactgtgtcgtcc

SEQ ID NO: 1369 - protein, 106 aa, Artificial Sequence
  source: /note="Description of Artificial Sequence: Synthetic polypeptide"
QIVLSQSPAILSASPGEKVTMTCRATSSVSSMNWYQQKPGSFPRPWIHATSNLASGVPARFSGSGSGTSYSLTISRVEAEDAATYYCQQWTFNPPTFGAGAKLELK

SEQ ID NO: 1370 - DNA, 318 bp, Artificial Sequence
  source: /note="Description of Artificial Sequence: Synthetic polynucleotide"
caaattgtcctgagccagagcccggctatcctgtccgcctcaccgggcgaaaaggtcaccatgacttgtcgggccacttcctccgtgtcatccatgaactggtaccagcagaagcctggcagcttccctcggccatggattcacgccacgtcaaacctggcatcgggagtgcccgcaaggttctccgggtccggcagcggaacatcctactccctcaccatctcgcgcgtggaagcggaggacgctgccacctactactgccaacagtggaccttcaacccccccacctttggagcgggagccaagctggaacttaag

SEQ ID NO: 1371 - protein, 122 aa, Artificial Sequence
  source: /note="Description of Artificial Sequence: Synthetic polypeptide"
QVQLQQPGAELVKPGASVKMSCKASGYTFTSYNMHWVKQTPGQGLEWIGAIYPGNGDTSYNPKFKGKATLTADKSSRTAYIHLSSLTSEDSVVYYCARSYFYGSSSWYFDVWGAGTTVTVSS

SEQ ID NO: 1372 - DNA, 366 bp, Artificial Sequence
  source: /note="Description of Artificial Sequence: Synthetic polynucleotide"
caagtgcagctgcagcagccgggagcagagctcgtgaagcctggagcctcagtgaagatgagctgcaaggcctccggttacaccttcacctcctacaacatgcactgggtcaagcagacccccggacaaggcctggaatggatcggcgccatctacccgggaaacggggacacctcctataaccccaagttcaagggaaaagcaaccctgaccgcggacaagtccagcagaactgcctacatccatctttcctcgctgacgtccgaggattccgtggtgtactactgtgcccgctcctacttctacgggtcatcctcgtggtacttcgatgtctggggcgctggaaccaccgtgactgtgtcctcc

SEQ ID NO: 1373 - protein, 106 aa, Artificial Sequence
  source: /note="Description of Artificial Sequence: Synthetic polypeptide"
QIILSQSPAILSASPGEKVTLTCRASSSVSSMHWYQQKPGSSPKPWIFATSNLASGVPARFTGSGSGTSYSLTISRVEAEDAATYYCQQWIFNPPTFGGGTSLEIK

SEQ ID NO: 1374 - DNA, 318 bp, Artificial Sequence
  source: /note="Description of Artificial Sequence: Synthetic polynucleotide"
cagatcattctgagccagagcccggccattctgtctgcctcgcctggagaaaaagtcaccctcacttgccgggccagctcctccgtgtcctcaatgcactggtaccagcagaagcctggctcaagcccgaagccctggatcttcgccacctccaatctggcgtcaggagtgcccgcgaggttcactggatcggggtccggcacatcgtattcgctcaccatttcccgggtggaggccgaggacgccgctacttactactgccaacagtggatcttcaacccaccgacctttggcggagggacttccttggaaatcaag

SEQ ID NO: 1375 - protein, 121 aa, Artificial Sequence
  source: /note="Description of Artificial Sequence: Synthetic polypeptide"
QIQLVQSGPELKKPGETVKISCKTSGYTFTSHGINWVKQAPRKGLKWMGWINTYTGEPTYGDDFKGRFAFSLETSARTAYLQINNLKNEDTATYFCARYGNYEEPYAMDYWGQGTSVTVSS

SEQ ID NO: 1376 - DNA, 363 bp, Artificial Sequence
  source: /note="Description of Artificial Sequence: Synthetic polynucleotide"
caaattcagctggtgcagtcgggacctgagctcaagaagcccggagaaaccgtgaagatctcctgcaagacttccgggtacacttttacttcccacggcatcaactgggtcaagcaggcaccaaggaaggggcttaagtggatgggctggattaacacctacaccggcgaacccacctatggcgatgacttcaaaggacggttcgcgttctccctcgaaacctcagcaagaaccgcgtatttgcaaatcaacaacctgaagaacgaggacaccgccacctacttctgcgcccgctacggaaattacgaggaaccttacgctatggactactggggccagggcacttccgtgactgtgtcgtcc

SEQ ID NO: 1377 - protein, 106 aa, Artificial Sequence; identical to SEQ ID NO: 1369
  source: /note="Description of Artificial Sequence: Synthetic polypeptide"

SEQ ID NO: 1378 - DNA, 318 bp, Artificial Sequence
  source: /note="Description of Artificial Sequence: Synthetic polynucleotide"
cagatcgtgctgagccagagccccgccatcctgagcgcttccccgggagaaaaggtcaccatgacttgccgggccactagcagcgtgtcctccatgaactggtaccagcagaagccgggctccttccctcgcccctggattcatgccacctcaaacctggccagcggagtgccagccagattctcgggatctggatcggggacgtcctactccctcaccatctcgcgggtggaggccgaagatgccgccacatactactgtcaacagtggaccttcaacccgccgacctttggagcgggggccaagctggagctgaaa

SEQ ID NO: 1379 - protein, 122 aa, Artificial Sequence
  source: /note="Description of Artificial Sequence: Synthetic polypeptide"
QVQLQQPGAELVKPGASVKMSCKASGYTFTSYNIHWVKQTPGQGLEWIGAIYPGNGDTSYNQKFKGKATLTADKSSTTAFIHFSSLTSEDSVVYYCARSYFYGSDSWYFDVWGAGTTVTVSS

SEQ ID NO: 1380 - DNA, 366 bp, Artificial Sequence
  source: /note="Description of Artificial Sequence: Synthetic polynucleotide"
caagtgcagcttcagcagcctggggccgaactcgtgaagccaggagcctccgtgaagatgtcatgcaaagcctccggctacacttttacctcctacaacattcattgggtcaagcagacacctggccagggcctggaatggattggtgcaatctacccgggcaacggagacacctcgtacaaccagaagtttaaggggaaggccaccctgaccgcggacaagtcaagcactaccgcgttcattcacttctcgtccttgacctccgaggatagcgtggtgtactactgcgcccgctcctatttctacggctccgattcgtggtacttcgacgtctggggagccggaactaccgtgaccgtgtcctcc

SEQ ID NO: 1381 - protein, 106 aa, Artificial Sequence
  source: /note="Description of Artificial Sequence: Synthetic polypeptide"
QIILSQSPAILSASPGEKVTLTCRASSGVPSLHWYQQKPGSSPKPWIFATSNLASGVPARFSGSGSGTSYSLTISRVEAEDAATYYCQQWIFNPPTFGGGTSLEIK

SEQ ID NO: 1382 - DNA, 318 bp, Artificial Sequence
  source: /note="Description of Artificial Sequence: Synthetic polynucleotide"
caaatcatcctgagccagagcccggccatcctgtcggcttcacccggggaaaaggtcacgctgacttgccgggcctcctccggcgtgccaagcctccactggtaccagcaaaagcctggctcgtcccccaaaccctggattttcgccacctccaacctggctagcggagtgccggccagattctcgggttccgggtccggcaccagctattctctcaccatctcccgggtcgaggcggaggacgcagcgacttactactgtcaacagtggatcttcaatccgcccaccttcggcggaggaacttccctggaaatcaag

SEQ ID NO: 1383 - protein, 122 aa, Artificial Sequence
  source: /note="Description of Artificial Sequence: Synthetic polypeptide"
QVQLLQPGAELVKPGASVKMSCKASGYTFTRYNMHWVKQTPGQGLEWIGAIYPGNGDTSYSQKFKGKATLTADKSSSTAYMQLSSLTSEDSAVYYCARSFFYGSSDWYFDVWGAGTTVSVSS

SEQ ID NO: 1384 - DNA, 366 bp, Artificial Sequence
  source: /note="Description of Artificial Sequence: Synthetic polynucleotide"
caagtgcagctgctgcagcccggagccgaactcgtgaagccgggcgcatccgtgaaaatgagctgcaaggcgtccggttacaccttcactcgctacaacatgcactgggtcaagcagacccctggacaaggcctggagtggattggtgctatctacccgggaaacggagacactagctactcgcagaaattcaagggaaaggccacgctgaccgccgataagtcctcctccactgcctacatgcaactcagctcactgacctcagaggactcggccgtgtactactgcgcgaggtccttcttctacgggtcctcggattggtacttcgacgtctggggcgccggtaccaccgtgtccgtgtcatcc

SEQ ID NO: 1385 - protein, 106 aa, Artificial Sequence
  source: /note="Description of Artificial Sequence: Synthetic polypeptide"
QIVLSQSPAILSTSPGEKVTLTCRASSSVNNMHWYQQKPGSSPKPWIYATSNLASGVPSRFSGSGSGTSYSLTISRVEAEDAATYYCQQWIFNPPTFGAGTKLELK

SEQ ID NO: 1386 - DNA, 318 bp, Artificial Sequence
  source: /note="Description of Artificial Sequence: Synthetic polynucleotide"
cagatcgtgctgagccagtccccggcgattctgtccacctcgcctggggaaaaggtcaccctgacatgtagagcctcctcctccgtgaacaatatgcattggtatcagcagaagccaggatcaagccccaagccctggatctatgccacttcgaaccttgcctctggagtgccctcacggttctccggctcgggatcggggaccagctacagcttgactatctcccgggtggaggctgaggacgccgcaacctactactgccagcaatggatcttcaaccctccgacttttggggccggaaccaagctggaactcaag

SEQ ID NO: 1387 - protein, 117 aa, Artificial Sequence
  source: /note="Description of Artificial Sequence: Synthetic polypeptide"
QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTV

SEQ ID NO: 1388 - DNA, 357 bp, Artificial Sequence
  source: /note="Description of Artificial Sequence: Synthetic polynucleotide"
caagtgcagttggtggaatcaggaggaggtgtcgtgcaaccaggaagatcattgaggctctcatgcgccgccagcggattcacctttcgggattactacatggcctgggtccgccaggccccggggaagggactggaatgggtggcatccatctcgtacgaagggaacccctactatggggactccgtgaagggacggttcaccatctcccgggacaacgccaagtccaccctgtaccttcaaatgtcctcgctgagggcggaggatactgctgtctactactgtgcccgccacgaccataacaacgtggactggttcgcctactggggccagggaaccctcgtcaccgtgtcctcg

SEQ ID NO: 1389 - protein, 112 aa, Artificial Sequence
  source: /note="Description of Artificial Sequence: Synthetic polypeptide"
DIVMTQTPLSLSVTPGQPVSMSCKSSQSLLYSENKKNYLAWYLQKPGQSPQLLIFWASTRESGVPDRFSGSGSGTDFTLKISRVEAEDVGVYYCQQYYNFPTFGQGTKLEIK

SEQ ID NO: 1390 - DNA, 336 bp, Artificial Sequence
  source: /note="Description of Artificial Sequence: Synthetic polynucleotide"
gacattgtgatgacgcagactcccctgtcgctctccgtgacccctggccagcccgtgtcgatgtcgtgcaagagctcccagtccctgctgtattccgagaacaagaagaattaccttgcgtggtacctccagaagccggggcagagcccgcagctgctgattttctgggcgtccactagagagtctggagtgcctgaccggtttagcggaagcggctccggtactgatttcaccctgaaaatctcgcgcgtggaagctgaggacgtgggcgtgtactactgccagcagtactacaacttccctactttcggacaaggaaccaagctggaaatcaag

SEQ ID NO: 1391 - protein, 20 aa, Artificial Sequence
  source: /note="Description of Artificial Sequence: Synthetic peptide"
GGGGSGGGGSGGGGSGGGGS

SEQ ID NO: 1392 - protein, 251 aa, Artificial Sequence
  source: /note="Description of Artificial Sequence: Synthetic polypeptide"
QVQLVESGGGVVQPGRSLRLSCAASGFTFRDYYMAWVRQAPGKGLEWVASISYEGNPYYGDSVKGRFTISRDNAKSTLYLQMSSLRAEDTAVYYCARHDHNNVDWFAYWGQGTLVTVSSGGGGSGGGGSGGGGSGGGGSDIVMTQTPLSLSVTPGQPVSMSCKSSQSLLYSENKKNYLAWYLQKPGQSPQLLIFWASTRESGVPDRFSGSGSGTDFTLKISRVEAEDVGVYYCQQYYNFPTFGQGTKLEIK

SEQ ID NO: 1393 - protein, 119 aa, Artificial Sequence
  source: /note="Description of Artificial Sequence: Synthetic polypeptide"
QVQLVQSGAEVKKPGASVKVSCKASGFTFRDYYMAWVRQAPGQRLEWMGSISYEGNPYYGDSVKGRVTITRDNSASTLYMELSSLRSEDTAVYYCARHDHNNVDWFAYWGQGTLVTVSS

SEQ ID NO: 1394 - DNA, 357 bp, Artificial Sequence
  source: /note="Description of Artificial Sequence: Synthetic polynucleotide"
caagtccaactcgtccagtccggtgcagaagtcaagaaaccaggagcttccgtgaaagtgtcgtgcaaagcttcaggcttcaccttccgcgactattacatggcctgggtccgccaagcgcccggacagcggctggagtggatggggtccatttcctacgaggggaacccctactatggagattccgtgaagggcagagtgacgatcactcgggataactccgcctccactctctacatggaactgtcctcgcttcggagcgaagataccgcggtgtactactgcgcccgccacgaccataacaacgtggactggttcgcctactggggacaggggaccctcgtgaccgtgtcctct

SEQ ID NO: 1395 - protein, 112 aa, Artificial Sequence
  source: /note="Description of Artificial Sequence: Synthetic polypeptide"
DIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 1396 - DNA, 336 bp, Artificial Sequence
  source: /note="Description of Artificial Sequence: Synthetic polynucleotide"
gacattcagatgacccagtccccgagctcgctgtccgcctccgtgggagacagagtgacaatcacttgcaagagcagccagtcactgttgtactccgagaacaagaagaactacctcgcctggtaccagcagaagccgggaaaggtccctaagctgctgatcttctgggccagcactagggagtcgggagtgccgtcacggttcagcggatcgggatcgggtaccgacttcaccctgactatctcctccctgcaacctgaggacgtggccacctactactgtcagcagtactacaattttcccaccttcggccagggtaccaagctggaaatcaag

SEQ ID NO: 1397 - protein, 20 aa, Artificial Sequence
  source: /note="Description of Artificial Sequence: Synthetic peptide"
GGGGSGGGGSGGGGSGGGGS

SEQ ID NO: 1398 - protein, 251 aa, Artificial Sequence
  source: /note="Description of Artificial Sequence: Synthetic polypeptide"
QVQLVQSGAEVKKPGASVKVSCKASGFTFRDYYMAWVRQAPGQRLEWMGSISYEGNPYYGDSVKGRVTITRDNSASTLYMELSSLRSEDTAVYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 1399 - protein, 119 aa, Artificial Sequence
  source: /note="Description of Artificial Sequence: Synthetic polypeptide"
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSS

SEQ ID NO: 1400 - DNA, 357 bp, Artificial Sequence
  source: /note="Description of Artificial Sequence: Synthetic polynucleotide"
gaagtccaactggtgcagtcaggagcagaagtcaaaaaaccaggagaaagcctcaagatcagctgcaagggctcgggtttcaccttccgggactactatatggcctgggtcagacagatgccgggaaagggactggaatggatggggtcaatcagctacgagggcaacccctactacggagactccgtgaagggacaggtcacaatctcccgggacaactcgatttccactctgtatctgcaatggagctccctcaaggcctccgacactgcgatgtactactgtgcgcggcatgaccacaacaatgtggattggttcgcctactggggacagggaaccctcgtgaccgtgtccagc

SEQ ID NO: 1401 - protein, 112 aa, Artificial Sequence; identical to SEQ ID NO: 1395
  source: /note="Description of Artificial Sequence: Synthetic polypeptide"

SEQ ID NO: 1402 - DNA, 336 bp, Artificial Sequence
  source: /note="Description of Artificial Sequence: Synthetic polynucleotide"
gatatccaaatgacccagtcgccctcctcactctccgcctccgtgggagatcgcgtgaccattacttgcaagagctcgcagtccctgctgtactccgagaacaagaagaactacttggcctggtaccagcagaagcccggcaaagtgccgaagctgcttatcttttgggcctcgaccagggaaagcggagtgccgtcacgcttctccggctccgggtctggcaccgacttcactctgactatttcctccctgcaacctgaggacgtggctacctactactgccagcagtactacaacttccctaccttcggccaagggacgaagctggagatcaag

SEQ ID NO: 1403 - protein, 20 aa, Artificial Sequence
  source: /note="Description of Artificial Sequence: Synthetic peptide"
GGGGSGGGGSGGGGSGGGGS

SEQ ID NO: 1404 - protein, 251 aa, Artificial Sequence
  source: /note="Description of Artificial Sequence: Synthetic polypeptide"
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSDIQMTQSPSSLSASVGDRVTITCKSSQSLLYSENKKNYLAWYQQKPGKVPKLLIFWASTRESGVPSRFSGSGSGTDFTLTISSLQPEDVATYYCQQYYNFPTFGQGTKLEIK

SEQ ID NO: 1405 - protein, 119 aa, Artificial Sequence; identical to SEQ ID NO: 1399
  source: /note="Description of Artificial Sequence: Synthetic polypeptide"

SEQ ID NO: 1406 - DNA, 357 bp, Artificial Sequence
  source: /note="Description of Artificial Sequence: Synthetic polynucleotide"
gaagtgcagttggtccaatcaggcgcagaagtgaagaaacccggagaatcattgaagatttcgtgcaaaggaagcgggttcacattccgcgattactacatggcgtgggtcagacagatgccgggaaagggactcgagtggatggggtccatcagctacgaaggaaacccttactacggggactccgtgaagggccaggtcaccatctcccgcgacaactcaatctccactctgtatctgcaatggtcgagcctcaaggcctctgatactgcgatgtactactgcgctcggcatgaccacaacaacgtggactggttcgcttactggggacagggtacccttgtgaccgtgtcctcc

SEQ ID NO: 1407 - protein, 112 aa, Artificial Sequence
  source: /note="Description of Artificial Sequence: Synthetic polypeptide"
EIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 1408 - DNA, 336 bp, Artificial Sequence
  source: /note="Description of Artificial Sequence: Synthetic polynucleotide"
gagatcgtgatgactcagtcccctgccaccctctcgctgtcccccggggagagggccacgctgtcctgcaagagctcccagtcactgctgtattccgaaaacaagaagaactacctcgcctggtaccaacagaagccgggacaggccccgcggcttctgatcttctgggcctccactcgggagtccggcattccggcccgcttctccggctcggggagcggaactgacttcaccctgaccatcagcagcctgcagccagaggacctcgcagtgtactactgtcaacagtactacaatttccccacctttggccagggtaccaagctggagattaag

SEQ ID NO: 1409 - protein, 20 aa, Artificial Sequence
  source: /note="Description of Artificial Sequence: Synthetic peptide"
GGGGSGGGGSGGGGSGGGGS

SEQ ID NO: 1410 - protein, 251 aa, Artificial Sequence
  source: /note="Description of Artificial Sequence: Synthetic polypeptide"
EVQLVQSGAEVKKPGESLKISCKGSGFTFRDYYMAWVRQMPGKGLEWMGSISYEGNPYYGDSVKGQVTISRDNSISTLYLQWSSLKASDTAMYYCARHDHNNVDWFAYWGQGTLVTVSSGGGGSGGGGSGGGGSGGGGSEIVMTQSPATLSLSPGERATLSCKSSQSLLYSENKKNYLAWYQQKPGQAPRLLIFWASTRESGIPARFSGSGSGTDFTLTISSLQPEDLAVYYCQQYYNFPTFGQGTKLEIK

SEQ ID NO: 1411 - protein, 5 aa, Artificial Sequence
  source: /note="Description of Artificial Sequence: Synthetic peptide"
DYAMH

SEQ ID NO: 1412 - protein, 17 aa, Artificial Sequence
  source: /note="Description of Artificial Sequence: Synthetic peptide"
TISWNSGSIGYADSVKG

SEQ ID NO: 1413 - protein, 13 aa, Artificial Sequence
  source: /note="Description of Artificial Sequence: Synthetic peptide"
DIQYGNYYYGMDV

SEQ ID NO: 1414 - protein, 7 aa, Artificial Sequence
  source: /note="Description of Artificial Sequence: Synthetic peptide"
GFTFNDY

SEQ ID NO: 1415 - protein, 6 aa, Artificial Sequence
  source: /note="Description of Artificial Sequence: Synthetic peptide"
SWNSGS

SEQ ID NO: 1416 - protein, 13 aa, Artificial Sequence
  source: /note="Description of Artificial Sequence: Synthetic peptide"
DIQYGNYYYGMDV

SEQ ID NO: 1417 - protein, 8 aa, Artificial Sequence
  source: /note="Description of Artificial Sequence: Synthetic peptide"
GFTFNDYA

SEQ ID NO: 1418 - protein, 8 aa, Artificial Sequence
  source: /note="Description of Artificial Sequence: Synthetic peptide"
ISWNSGSI

SEQ ID NO: 1419 - protein, 15 aa, Artificial Sequence
  source: /note="Description of Artificial Sequence: Synthetic peptide"
AKDIQYGNYYYGMDV

SEQ ID NO: 1420 - protein, 122 aa, Artificial Sequence
  source: /note="Description of Artificial Sequence: Synthetic polypeptide"
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 1421 - DNA, 366 bp, Artificial Sequence
  source: /note="Description of Artificial Sequence: Synthetic polynucleotide"
gaggtgcagctggtcgagtcggggggaggattggtgcagccgggcagaagcctgcggctctcatgtgccgcctccggcttcacctttaacgactacgcaatgcactgggtcagacaggctcctgggaagggcctggaatgggtgtccaccatttcctggaactccgggagcatcggctacgctgactccgtgaagggccgcttcacgattagccgcgataacgcgaaaaagagcctgtacctccaaatgaactccctgcgggccgaagataccgccctttactactgcgcgaaggacattcagtatggaaactactactacggaatggacgtctggggacaggggaccacagtgaccgtgtcaagc

SEQ ID NO: 1422 - protein, 11 aa, Artificial Sequence
  source: /note="Description of Artificial Sequence: Synthetic peptide"
RASQSVSSYLA

SEQ ID NO: 1423 - protein, 7 aa, Artificial Sequence
  source: /note="Description of Artificial Sequence: Synthetic peptide"
DASNRAT

SEQ ID NO: 1424 - protein, 9 aa, Artificial Sequence
  source: /note="Description of Artificial Sequence: Synthetic peptide"
QQRSNWPIT

SEQ ID NO: 1425 - protein, 7 aa, Artificial Sequence
  source: /note="Description of Artificial Sequence: Synthetic peptide"
SQSVSSY

SEQ ID NO: 1426 - protein, 3 aa, Artificial Sequence
  source: /note="Description of Artificial Sequence: Synthetic peptide"
DAS

SEQ ID NO: 1427 - protein, 6 aa, Artificial Sequence
  source: /note="Description of Artificial Sequence: Synthetic peptide"
RSNWPI

SEQ ID NO: 1428 - protein, 6 aa, Artificial Sequence
  source: /note="Description of Artificial Sequence: Synthetic peptide"
QSVSSY

SEQ ID NO: 1429 - protein, 3 aa, Artificial Sequence
  source: /note="Description of Artificial Sequence: Synthetic peptide"
DAS

SEQ ID NO: 1430 - protein, 9 aa, Artificial Sequence
  source: /note="Description of Artificial Sequence: Synthetic peptide"
QQRSNWPIT

SEQ ID NO: 1431 - protein, 107 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 1432 - DNA, 321 bp, Artificial Sequence
  source: /note="Description of Artificial Sequence: Synthetic polynucleotide"
gaaatcgtgctgacccagagcccagccactttgtcactgtcccccggcgaaagagccactctgtcctgccgggcatcgcagtccgtgtcgtcctacctggcctggtaccagcaaaagcccggacaagcccctcgccttctcatctacgacgcctccaatcgcgcgaccggaatcccggccaggttctccgggagcggttcaggcactgacttcaccctgaccatctcgtccctggagccggaggatttcgccgtgtattactgccagcagcggtccaactggcccatcaccttcggccaagggactcggctcgaaatcaag

SEQ ID NO: 1433 - protein, 20 aa, Artificial Sequence
  source: /note="Description of Artificial Sequence: Synthetic peptide"
GGGGSGGGGSGGGGSGGGGS

SEQ ID NO: 1434 - protein, 249 aa, Artificial Sequence
  source: /note="Description of Artificial Sequence: Synthetic polypeptide"
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGGSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 1435 - DNA, 747 bp, Artificial Sequence
  source: /note="Description of Artificial Sequence: Synthetic polynucleotide"
gaggtgcagctggtcgagtcggggggaggattggtgcagccgggcagaagcctgcggctctcatgtgccgcctccggcttcacctttaacgactacgcaatgcactgggtcagacaggctcctgggaagggcctggaatgggtgtccaccatttcctggaactccgggagcatcggctacgctgactccgtgaagggccgcttcacgattagccgcgataacgcgaaaaagagcctgtacctccaaatgaactccctgcgggccgaagataccgccctttactactgcgcgaaggacattcagtatggaaactactactacggaatggacgtctggggacaggggaccacagtgaccgtgtcaagcggcggtggaggatctggcggaggaggttccggtggcggtggatcgggagggggaggatcggaaatcgtgctgacccagagcccagccactttgtcactgtcccccggcgaaagagccactctgtcctgccgggcatcgcagtccgtgtcgtcctacctggcctggtaccagcaaaagcccggacaagcccctcgccttctcatctacgacgcctccaatcgcgcgaccggaatcccggccaggttctccgggagcggttcaggcactgacttcaccctgaccatctcgtccctggagccggaggatttcgccgtgtattactgccagcagcggtccaactggcccatcaccttcggccaagggactcggctcgaaatcaag

SEQ ID NO: 1436 - protein, 119 aa, Artificial Sequence
  source: /note="Description of Artificial Sequence: Synthetic polypeptide"
EVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSS

SEQ ID NO: 1437 - protein, 112 aa, Artificial Sequence
  source: /note="Description of Artificial Sequence: Synthetic polypeptide"
DIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIK

SEQ ID NO: 1438 - protein, 20 aa, Artificial Sequence
  source: /note="Description of Artificial Sequence: Synthetic peptide"
GGGGSGGGGSGGGGSGGGGS

SEQ ID NO: 1439 - protein, 251 aa, Artificial Sequence
  source: /note="Description of Artificial Sequence: Synthetic polypeptide"
EVQLVESGGGLVQPGRSLKLSCAASGFTFRDYYMAWVRQAPKKGLEWVASISYEGNPYYGDSVKGRFTISRNNAKSTLYLQMNSLRSEDTATYYCARHDHNNVDWFAYWGQGTLVTVSSGGGGSGGGGSGGGGSGGGGSDIVMTQTPSSQAVSAGEKVTMSCKSSQSLLYSENKKNYLAWYQQKPGQSPKLLIFWASTRESGVPDRFIGSGSGTDFTLTISSVQAEDLAVYYCQQYYNFPTFGSGTKLEIK

SEQ ID NO: 1440 - protein, 122 aa, Artificial Sequence
  source: /note="Description of Artificial Sequence: Synthetic polypeptide"
EVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 1441 - DNA, 366 bp, Artificial Sequence
  source: /note="Description of Artificial Sequence: Synthetic polynucleotide"
gaggtgcaactgcagcagtcaggagcagaactggtcaagccgggcgcatccgtcaagatgagctgcaaggcctcaggatacaccttcacttcatacaacatgcactgggtcaagcagacgcctgggcaggggctggagtggatcggtgccatctaccccggaaacggcgacacctcctacaaccagaagttcaagggaaaggccaccctcaccgctgataagtccagcagcaccgcctacatgcaactgtcgtccctgacttcggaggacagcgctgactactattgcgcccgctctaattactacggttcctcctactggttcttcgacgtgtggggcgcgggtaccactgtgactgtctccagc

SEQ ID NO: 1442 - protein, 106 aa, Artificial Sequence
  source: /note="Description of Artificial Sequence: Synthetic polypeptide"
DIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIK

SEQ ID NO: 1443 - DNA, 318 bp, Artificial Sequence
  source: /note="Description of Artificial Sequence: Synthetic polynucleotide"
gacatcgtgctcactcagtcgcccgccattctgagcgctagccccggcgaaaaggtcaccatgacctgtagagcgtcatcctcggtgaactacatggactggtaccagaagaagccgggatcgagccctaagccatggatctacgccacatccaatctggcgtccggcgtgccggcccggttcagcgggagcggctcaggcacctcctattccctcaccatctcgagagtggaggctgaggatgcagccacgtactactgtcagcagtggtcgttcaaccccccaacctttggtggtggaaccaagctggaaatcaag

SEQ ID NO: 1444 - protein, 18 aa, Artificial Sequence
  source: /note="Description of Artificial Sequence: Synthetic peptide"
GSTSGGGSGGGSGGGGSS

SEQ ID NO: 1445 - protein, 246 aa, Artificial Sequence
  source: /note="Description of Artificial Sequence: Synthetic polypeptide"
DIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKGSTSGGGSGGGSGGGGSSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSS

SEQ ID NO: 1446 - DNA, 738 bp, Artificial Sequence
  source: /note="Description of Artificial Sequence: Synthetic polynucleotide"
gacatcgtgctcactcagtcgcccgccattctgagcgctagccccggcgaaaaggtcaccatgacctgtagagcgtcatcctcggtgaactacatggactggtaccagaagaagccgggatcgagccctaagccatggatctacgccacatccaatctggcgtccggcgtgccggcccggttcagcgggagcggctcaggcacctcctattccctcaccatctcgagagtggaggctgaggatgcagccacgtactactgtcagcagtggtcgttcaaccccccaacctttggtggtggaaccaagctggaaatcaagggaagcacctccggcggaggttccggaggagggtccggaggcggaggcagctccgaggtgcaactgcagcagtcaggagcagaactggtcaagccgggcgcatccgtcaagatgagctgcaaggcctcaggatacaccttcacttcatacaacatgcactgggtcaagcagacgcctgggcaggggctggagtggatcggtgccatctaccccggaaacggcgacacctcctacaaccagaagttcaagggaaaggccaccctcaccgctgataagtccagcagcaccgcctacatgcaactgtcgtccctgacttcggaggacagcgctgactactattgcgcccgctctaattactacggttcctcctactggttcttcgacgtgtggggcgcgggtaccactgtgactgtctccagc

SEQ ID NO: 1447 - protein, 243 aa, Artificial Sequence
  source: /note="Description of Artificial Sequence: Synthetic polypeptide"
EVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSGGGGSQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVL

SEQ ID NO: 1448 - protein, 253 aa, Artificial Sequence
  source: /note="Description of Artificial Sequence: Synthetic polypeptide"
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSGGGGSGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 1449 - protein, 243 aa, Artificial Sequence
  source: /note="Description of Artificial Sequence: Synthetic polypeptide"
QSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLGGGGSEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSS

SEQ ID NO: 1450 - protein, 559 aa, Artificial Sequence
  source: /note="Description of Artificial Sequence: Synthetic polypeptide"
MALPVTALLLPLALLLHAARPEVQLVESGGGLVQPGGSLRLSCAVSGFALSNHGMSWVRRAPGKGLEWVSGIVYSGSTYYAASVKGRFTISRDNSRNTLYLQMNSLRPEDTAIYYCSAHGGESDVWGQGTTVTVSSASGGGGSGGRASGGGGSDIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGGGSGGGGTGGGGSGMHKRSHTGERPFQCNQCGASFTQKGNLLRHIKLHTGEKPFKCHLCNTASAEARHIKAEMG

SEQ ID NO: 1451 - protein, 246 aa, Artificial Sequence
  source: /note="Description of Artificial Sequence: Synthetic polypeptide"
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 1452 - DNA, 738 bp, Artificial Sequence
  source: /note="Description of Artificial Sequence: Synthetic polynucleotide"
gaaatccagctggtccaatcgggagctgaggtcaagaagccgggagccaccgtcaagatctcatgcaaggggtcgggattcaacatcgaggactactacattcactgggtgcagcaagctccgggaaaaggcctggaatggatgggcagaatcgacccagaaaacgacgaaactaagtacggaccgattttccaaggaagagtgactatcaccgccgatacttcaaccaataccgtctacatggaactgagctcgctccggtccgaagatactgcagtgtattactgtgcctttcgcggaggggtgtactggggccaaggaactactgtcactgtctcgtcaggaggcggagggtcgggaggaggcgggagcggaggcggtggctcgggtggcggaggaagcgacgtggtgatgacccagtccccggactccctcgccgtgagcctcggagagagggcgactatcaattgcaagtcgtcccagtcacttctggattccgatggtaaaacgtacctcaactggctgcagcaaaagccagggcagccacccaaacggttgatctcccttgtgtccaaactggatagcggagtgcctgaccgcttctcgggttccggtagcgggaccgacttcaccctgacgatcagctcactgcaggcggaggacgtggcagtgtactactgctggcagggaacccacttccctggcacctttggaggtggcaccaaggtggagatcaag

SEQ ID NO: 1453 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctggtccaatcgggagctgaggtcaagaagccgggagccaccgtcaagatctcatgcaaggggtcgggattcaacatcgaggactactacattcactgggtgcagcaagctccgggaaaaggcctggaatggatgggcagaatcgacccagaaaacgacgaaactaagtacggaccgattttccaaggaagagtgactatcaccgccgatacttcaaccaataccgtctacatggaactgagctcgctccggtccgaagatactgcagtgtattactgtgcctttcgcggaggggtgtactggggccaaggaactactgtcactgtctcgtcaggaggcggagggtcgggaggaggcgggagcggaggcggtggctcgggtggcggaggaagcgacgtggtgatgacccagtccccggactccctcgccgtgagcctcggagagagggcgactatcaattgcaagtcgtcccagtcacttctggattccgatggtaaaacgtacctcaactggctgcagcaaaagccagggcagccacccaaacggttgatctcccttgtgtccaaactggatagcggagtgcctgaccgcttctcgggttccggtagcgggaccgacttcaccctgacgatcagctcactgcaggcggaggacgtggcagtgtactactgctggcagggaacccacttccctggcacctttggaggtggcaccaaggtggagatcaagggatcgcaccaccatcaccatcatcatcac

SEQ ID NO: 1454 - protein, 277 aa, Artificial Sequence
  source: /note="Description of Artificial Sequence: Synthetic polypeptide"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHH

SEQ ID NO: 1455 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgagatccagctggtgcagtcgggagctgaagtcaaaaagcctggcgcaaccgtcaagatctcgtgcaaaggatcagggttcaacatcgaggactactacatccattgggtgcaacaggcacccggaaaaggcctggagtggatggggaggattgacccagaaaatgacgaaaccaagtacggaccgatcttccaaggacgggtgaccatcacggctgacacttccactaacaccgtctacatggaactctcgagccttcgctcggaagataccgcggtgtactactgcgcctttagaggtggagtctactggggacaagggactaccgtcaccgtgtcgtcaggtggcggaggatcaggcggaggcggctccggtggaggaggaagcggaggaggtggctccgacgtggtgatgacgcagtcaccggactccttggcggtgagcctgggtgaacgcgccactatcaactgcaagagctcccagagcttgctggactccgatggaaagacttatctcaattggctgcaacagaagcctggccagccgccaaagagactcatctcactggtgagcaagctggatagcggagtgccagatcggttttcgggatcgggctcaggcaccgacttcaccctgactatttcctccctccaagccgaggatgtggccgtctactactgttggcaggggactcacttcccggggaccttcggtggaggcactaaggtggagatcaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1456 - protein, 490 aa, Artificial Sequence
  source: /note="Description of Artificial Sequence: Synthetic polypeptide"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1457 - protein, 246 aa, Artificial Sequence
  source: /note="Description of Artificial Sequence: Synthetic polypeptide"
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 1458 - DNA, 738 bp, Artificial Sequence
  source: /note="Description of Artificial Sequence: Synthetic polynucleotide"
gatgtcgtgatgacccagtccccagactccctcgcagtgtccttgggagaacgggccaccatcaactgcaaatcgagccagtcactgctggactcagacggaaagacctacctcaactggctgcagcagaagcctggccagccaccgaagcgcctgatctccctggtgtccaagctggactcgggcgtcccggacaggtttagcggtagcggctcgggaaccgacttcactctgaccattagctcgctccaagctgaagatgtggcggtctactactgctggcaggggacccacttccccgggacctttggcggaggaactaaagtcgaaatcaaaggaggaggcggatcaggtggaggaggcagcggaggaggagggagcggcggtggcggctccgaaattcaacttgtgcaatccggtgccgaggtgaagaaacctggtgccactgtcaagatctcgtgtaagggatcgggattcaatatcgaggactactacatccactgggtgcaacaggcgccaggaaagggattggagtggatgggtcgcatcgacccggaaaacgatgagactaagtacggaccgatcttccaaggccgggtcacgatcactgcggatacctccactaataccgtgtatatggagctctcgtcactgagaagcgaagatacggccgtgtactactgcgcattcagaggaggtgtgtactggggccagggaactactgtgaccgtgtcgtcg

SEQ ID NO: 1459 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgatgtcgtgatgacccagtccccagactccctcgcagtgtccttgggagaacgggccaccatcaactgcaaatcgagccagtcactgctggactcagacggaaagacctacctcaactggctgcagcagaagcctggccagccaccgaagcgcctgatctccctggtgtccaagctggactcgggcgtcccggacaggtttagcggtagcggctcgggaaccgacttcactctgaccattagctcgctccaagctgaagatgtggcggtctactactgctggcaggggacccacttccccgggacctttggcggaggaactaaagtcgaaatcaaaggaggaggcggatcaggtggaggaggcagcggaggaggagggagcggcggtggcggctccgaaattcaacttgtgcaatccggtgccgaggtgaagaaacctggtgccactgtcaagatctcgtgtaagggatcgggattcaatatcgaggactactacatccactgggtgcaacaggcgccaggaaagggattggagtggatgggtcgcatcgacccggaaaacgatgagactaagtacggaccgatcttccaaggccgggtcacgatcactgcggatacctccactaataccgtgtatatggagctctcgtcactgagaagcgaagatacggccgtgtactactgcgcattcagaggaggtgtgtactggggccagggaactactgtgaccgtgtcgtcggggtcacatcaccaccatcatcatcaccac

SEQ ID NO: 1460 - protein, 277 aa, Artificial Sequence
  source: /note="Description of Artificial Sequence: Synthetic polypeptide"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 1461 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgacgtggtcatgactcaaagcccagattccttggctgtctcccttggagaaagagcaacgatcaattgcaaaagctcgcagtccctgttggactccgatggaaaaacctacctcaactggctgcagcagaagccgggacaaccaccaaagcggctgatttccctcgtgtccaagctggacagcggcgtgccggatcgcttctcgggcagcggctcgggaaccgattttactctcactatttcgtcactgcaagcggaggacgtggcggtgtattactgctggcagggcactcacttcccgggtacttttggtggaggtaccaaagtcgaaatcaagggtggaggcgggagcggaggaggcgggtcgggaggaggaggatcgggtggcggaggctcagaaatccagctggtgcagtcaggtgccgaagtgaagaagcctggggccacggtgaagatctcgtgcaaggggagcggattcaacatcgaggattactacatccattgggtgcaacaggcccctggcaaagggctggaatggatgggaaggatcgaccccgagaatgacgagactaagtacggcccgatcttccaaggacgggtgaccatcactgcagacacttcaaccaacaccgtctacatggaactctcctcgctgcgctccgaggacaccgccgtgtactactgtgctttcagaggaggagtctactggggacagggaacgaccgtgaccgtcagctcaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1462 - protein, 490 aa, Artificial Sequence
  source: /note="Description of Artificial Sequence: Synthetic polypeptide"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1463 - protein, 246 aa, Artificial Sequence
  source: /note="Description of Artificial Sequence: Synthetic polypeptide"
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 1464 - DNA, 738 bp, Artificial Sequence
  source: /note="Description of Artificial Sequence: Synthetic polynucleotide"
gagattcagctggtccaaagcggcgcagaagtgaaaaagccaggggaatcgttgcgcatcagctgtaaaggttccggcttcaacatcgaggactattacatccattgggtgcggcagatgccaggaaaggggctggaatggatgggacggattgacccggagaacgacgaaaccaagtacggaccgatctttcaaggacacgtgactatctccgccgacaccagcatcaatacggtgtacctccaatggtcctcactcaaggcctcggataccgcgatgtactactgcgcgttcagaggaggcgtctactggggacaagggactactgtgactgtctcatcaggaggtggaggaagcggaggaggtggctcgggcggaggtggatcgggaggaggagggtccgatgtggtgatgacccagtccccactgtcgctcccggtgaccctcggacagcctgctagcatctcgtgcaaatcctcgcaatccctgctggactcggacggaaaaacgtacctcaattggctgcagcagcgccctggccagagcccgagaaggcttatctcgctggtgtcaaagctggatagcggtgtgcccgaccggttcagcggctcagggtcaggaaccgatttcaccttgaagatctcccgcgtggaagccgaagatgtcggagtctactactgctggcagggtactcacttcccggggacctttggtggcggcactaaggtcgagattaag

SEQ ID NO: 1465 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgagattcagctggtccaaagcggcgcagaagtgaaaaagccaggggaatcgttgcgcatcagctgtaaaggttccggcttcaacatcgaggactattacatccattgggtgcggcagatgccaggaaaggggctggaatggatgggacggattgacccggagaacgacgaaaccaagtacggaccgatctttcaaggacacgtgactatctccgccgacaccagcatcaatacggtgtacctccaatggtcctcactcaaggcctcggataccgcgatgtactactgcgcgttcagaggaggcgtctactggggacaagggactactgtgactgtctcatcaggaggtggaggaagcggaggaggtggctcgggcggaggtggatcgggaggaggagggtccgatgtggtgatgacccagtccccactgtcgctcccggtgaccctcggacagcctgctagcatctcgtgcaaatcctcgcaatccctgctggactcggacggaaaaacgtacctcaattggctgcagcagcgccctggccagagcccgagaaggcttatctcgctggtgtcaaagctggatagcggtgtgcccgaccggttcagcggctcagggtcaggaaccgatttcaccttgaagatctcccgcgtggaagccgaagatgtcggagtctactactgctggcagggtactcacttcccggggacctttggtggcggcactaaggtcgagattaagggctcacaccatcatcaccatcaccaccac

SEQ ID NO: 1466 - protein, 277 aa, Artificial Sequence
  source: /note="Description of Artificial Sequence: Synthetic polypeptide"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 1467 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctggtgcaaagcggagccgaggtgaagaagcccggagaatccctgcgcatctcgtgtaagggttccggctttaacatcgaggattactacatccactgggtgagacagatgccgggcaaaggtctggaatggatgggccgcatcgacccggagaacgacgaaaccaaatacggaccaatcttccaaggacatgtgactatttccgcggatacctccatcaacactgtctacttgcagtggagctcgctcaaggcgtcggataccgccatgtactactgcgcattcagaggaggtgtgtactggggccagggcactacggtcaccgtgtcctcgggaggtggagggtcaggaggcggaggctcgggcggtggaggatcaggcggaggaggaagcgatgtggtcatgactcaatccccactgtcactgcctgtcactctggggcaaccggcttccatctcatgcaagtcaagccaatcgctgctcgactccgacggaaaaacctacctcaattggcttcagcagcgcccaggccagtcgcctcggaggctgatctcactcgtgtcgaagcttgactccggggtgccggatcggtttagcggaagcggatcggggaccgacttcacgttgaagattagccgggtggaagccgaggacgtgggagtctattactgctggcaggggacccacttcccggggactttcggaggaggcaccaaagtcgagattaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1468 - protein, 490 aa, Artificial Sequence
  source: /note="Description of Artificial Sequence: Synthetic polypeptide"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1469 - protein, 246 aa, Artificial Sequence
  source: /note="Description of Artificial Sequence: Synthetic polypeptide"
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 1470 - DNA, 738 bp, Artificial Sequence
  source: /note="Description of Artificial Sequence: Synthetic polynucleotide"
gacgtcgtcatgacccagagcccgctgtcactgcctgtgaccctgggccagccggcgtccattagctgcaaatcctcgcaatccctgctcgactcagacggaaaaacgtacttgaactggctccaacagcgccctgggcaatccccaaggcggcttatctcactcgtcagcaagctcgatagcggtgtcccagacagattttcgggctcgggatcgggcactgatttcactctgaagatctcgcgggtggaagccgaggatgtgggagtgtactattgctggcagggcactcacttccccgggacgtttggcggaggaactaaggtcgagatcaaaggaggaggtggatcaggcggaggtgggagcggaggaggaggaagcggtggtggaggttccgaaatccagctggtgcaatcaggagccgaggtgaagaagccgggagaatccctgcgcatctcgtgcaagggctcgggcttcaacatcgaggattactacatccactgggtgcggcagatgccgggaaaggggttggaatggatgggacgcattgacccggaaaatgatgaaaccaaatacgggccaatcttccaaggccacgtgaccattagcgctgacacttccatcaacaccgtgtaccttcagtggtcctcactgaaggcgtcggacactgccatgtactactgtgcattcagaggaggggtctactggggacagggcaccaccgtgaccgtgagctcc

SEQ ID NO: 1471 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtcatgacccagagcccgctgtcactgcctgtgaccctgggccagccggcgtccattagctgcaaatcctcgcaatccctgctcgactcagacggaaaaacgtacttgaactggctccaacagcgccctgggcaatccccaaggcggcttatctcactcgtcagcaagctcgatagcggtgtcccagacagattttcgggctcgggatcgggcactgatttcactctgaagatctcgcgggtggaagccgaggatgtgggagtgtactattgctggcagggcactcacttccccgggacgtttggcggaggaactaaggtcgagatcaaaggaggaggtggatcaggcggaggtgggagcggaggaggaggaagcggtggtggaggttccgaaatccagctggtgcaatcaggagccgaggtgaagaagccgggagaatccctgcgcatctcgtgcaagggctcgggcttcaacatcgaggattactacatccactgggtgcggcagatgccgggaaaggggttggaatggatgggacgcattgacccggaaaatgatgaaaccaaatacgggccaatcttccaaggccacgtgaccattagcgctgacacttccatcaacaccgtgtaccttcagtggtcctcactgaaggcgtcggacactgccatgtactactgtgcattcagaggaggggtctactggggacagggcaccaccgtgaccgtgagctccggctcgcatcaccatcatcaccaccatcac

SEQ ID NO: 1472 - protein, 277 aa, Artificial Sequence
  source: /note="Description of Artificial Sequence: Synthetic polypeptide"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHH

SEQ ID NO: 1473 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgacgtcgtcatgacccaatcccctctctccctgccggtcaccctgggtcagccggcgtcgatctcatgcaaaagctcacagtccctgctggattcggacggaaaaacctacttgaactggctccaacagaggccgggtcagtcccctcgcagactgatctcgctggtgagcaagctcgactcgggtgtgccggatcggttctccgggtcaggatcgggcaccgactttacgctcaagatttcgagagtggaggccgaggatgtgggagtgtactattgctggcagggcacgcatttccccgggacctttggaggcgggactaaggtggaaatcaagggaggtggcggatcaggcggaggaggcagcggcggaggtggatcaggaggcggagggtcagagatccagctggtccaaagcggagcagaggtgaagaagccaggcgagtcccttcgcatttcgtgcaaagggagcggcttcaacattgaagattactacatccactgggtgcggcaaatgccaggaaagggtctggaatggatgggacggatcgacccagaaaatgatgaaactaagtacggaccgatcttccaaggacacgtcactatctccgcggacacttcgatcaacaccgtgtacctccagtggagcagcttgaaagcctccgacaccgctatgtactactgtgccttccgcggaggagtctactggggacaggggactactgtgaccgtgtcgtccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1474 - protein, 490 aa, Artificial Sequence
  source: /note="Description of Artificial Sequence: Synthetic polypeptide"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1475 - protein, 246 aa, Artificial Sequence
  source: /note="Description of Artificial Sequence: Synthetic polypeptide"
EIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIK

SEQ ID NO: 1476 - DNA, 738 bp, Artificial Sequence
  source: /note="Description of Artificial Sequence: Synthetic polynucleotide"
gaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaa

SEQ ID NO: 1477 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaagggagccaccatcatcatcaccaccaccac

SEQ ID NO: 1478 - protein, 277 aa, Artificial Sequence
  source: /note="Description of Artificial Sequence: Synthetic polypeptide"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGSHHHHHHHH

SEQ ID NO: 1479 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctcgtgcagagcggagccgaggtcaagaaaccgggtgctaccgtgaagatttcatgcaagggatcgggcttcaacatcgaggattactacatccactgggtgcagcaggcaccaggaaaaggacttgaatggatgggccggatcgacccggaaaatgacgagactaagtacggccctatcttccaaggacgggtgacgatcaccgcagacactagcaccaacaccgtctatatggaactctcgtccctgaggtccgaagatactgccgtgtactactgtgcgtttcgcggaggtgtgtactggggacagggtaccaccgtcaccgtgtcatcgggcggtggaggctccggtggaggagggtcaggaggcggtggaagcggaggaggcggcagcgacgtggtcatgactcaatcgccgctgtcgctgcccgtcactctgggacaacccgcgtccatcagctgcaaatcctcgcagtcactgcttgactccgatggaaagacctacctcaactggctgcagcaacgcccaggccaatccccaagacgcctgatctcgttggtgtcaaagctggactcaggggtgccggaccggttctccgggagcgggtcgggcacggatttcactctcaagatctccagagtggaagccgaggatgtgggagtctactactgctggcagggaacccatttccctggaacttttggcggaggaactaaggtcgagattaaaaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1480 - protein, 490 aa, Artificial Sequence
  source: /note="Description of Artificial Sequence: Synthetic polypeptide"
MALPVTALLLPLALLLHAARPEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGGGGSGGGGSGGGGSGGGGSDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1481 - protein, 246 aa, Artificial Sequence
  source: /note="Description of Artificial Sequence: Synthetic polypeptide"
EIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIK

SEQ ID NO: 1482 - DNA, 738 bp, Artificial Sequence
  source: /note="Description of Artificial Sequence: Synthetic polynucleotide"
gaaatccagctggtgcagtcaggcgccgaggtcaagaagccgggagagtcgctgagaatctcgtgcaagggctcggggttcaacatcgaggactactacattcactgggtcaggcagatgccgggaaagggactggaatggatgggccggatcgacccagaaaatgacgaaaccaaatacgggccgatttttcaaggccacgtgactatcagcgcagacacgagcatcaacactgtctacctccagtggtcctcgcttaaggccagcgataccgctatgtactactgcgcattcagaggcggggtgtactggggacaaggaaccactgtgaccgtgagcagcggaggtggcggctcgggaggaggtgggagcggaggaggaggttccggcggtggaggatcagatgtcgtgatgacccagtccccggactccctcgctgtctcactgggcgagcgcgcgaccatcaactgcaaatcgagccagtcgctgttggactccgatggaaagacttatctgaattggctgcaacagaaaccaggacaacctcccaagcggctcatctcgcttgtgtcaaaactcgattcgggagtgccagaccgcttctcggggtccgggagcggaactgactttactttgaccatttcctcactgcaagcggaggatgtggccgtgtattactgttggcagggcacgcatttccctggaaccttcggtggcggaactaaggtggaaatcaag

SEQ ID NO: 1483 - DNA, 834 bp, Artificial Sequence
  source: /note="Description of Artificial Sequence: Synthetic polynucleotide"
atggccctccctgtcaccgccctgctgcttccgctggctcttctgctccacgccgctcggcccgaaatccagctggtgcagtcaggcgccgaggtcaagaagccgggagagtcgctgagaatctcgtgcaagggctcggggttcaacatcgaggactactacattcactgggtcaggcagatgccgggaaagggactggaatggatgggccggatcgacccagaaaatgacgaaaccaaatacgggccgatttttcaaggccacgtgactatcagcgcagacacgagcatcaacactgtctacctccagtggtcctcgcttaaggccagcgataccgctatgtactactgcgcattcagaggcggggtgtactggggacaaggaaccactgtgaccgtgagcagcggaggtggcggctcgggaggaggtgggagcggaggaggaggttccggcggtggaggatcagatgtcgtgatgacccagtccccggactccctcgctgtctcactgggcgagcgcgcgaccatcaactgcaaatcgagccagtcgctgttggactccgatggaaagacttatctgaattggctgcaacagaaaccaggacaacctcccaagcggctcatctcgcttgtgtcaaaactcgattcgggagtgccagaccgcttctcggggtccgggagcggaactgactttactttgaccatttcctcactgcaagcggaggatgtggccgtgtattactgttggcagggcacgcatttccctggaaccttcggtggcggaactaaggtggaaatcaagggatcacaccaccatcatcaccatcaccaccat

SEQ ID NO: 1484 - protein, 278 aa, Artificial Sequence
  source: /note="Description of Artificial Sequence: Synthetic polypeptide"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGSHHHHHHHHH

SEQ ID NO: 1485 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgagattcagctcgtgcaatcgggagcggaagtcaagaagccaggagagtccttgcggatctcatgcaagggtagcggctttaacatcgaggattactacatccactgggtgaggcagatgccggggaagggactcgaatggatgggacggatcgacccagaaaacgacgaaactaagtacggtccgatcttccaaggccatgtgactattagcgccgatacttcaatcaataccgtgtatctgcaatggtcctcattgaaagcctcagataccgcgatgtactactgtgctttcagaggaggggtctactggggacagggaactaccgtgactgtctcgtccggcggaggcgggtcaggaggtggcggcagcggaggaggagggtccggcggaggtgggtccgacgtcgtgatgacccagagccctgacagcctggcagtgagcctgggcgaaagagctaccattaactgcaaatcgtcgcagagcctgctggactcggacggaaaaacgtacctcaattggctgcagcaaaagcctggccagccaccgaagcgccttatctcactggtgtcgaagctggattcgggagtgcccgatcgcttctccggctcgggatcgggtactgacttcaccctcactatctcctcgcttcaagcagaggacgtggccgtctactactgctggcagggaacccactttccgggaaccttcggcggagggacgaaagtggagatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1486 - protein, 490 aa, Artificial Sequence
  source: /note="Description of Artificial Sequence: Synthetic polypeptide"
MALPVTALLLPLALLLHAARPEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1487 - protein, 246 aa, Artificial Sequence
  source: /note="Description of Artificial Sequence: Synthetic polypeptide"
DVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSS

SEQ ID NO: 1488 - DNA, 738 bp, Artificial Sequence
  source: /note="Description of Artificial Sequence: Synthetic polynucleotide"
gacgtggtgatgacccaatcgccagattccctggcagtgtccctgggcgaacgcgccactattaactgcaaatcgtcacagtccttgcttgattccgacggaaagacctacctcaattggctccagcagaagccaggacaaccgccaaagagactgatctccctggtgtcaaagctggactcgggagtgcctgatcggttctcgggtagcgggagcggcaccgacttcactctgaccatctcgtcactccaggctgaggacgtggccgtgtattactgttggcagggtactcactttccgggcactttcggaggcggcaccaaggtggagattaaaggaggaggcggaagcggaggtggaggatcgggaggtggtgggagcggcggaggagggagcgagatccagctcgtccaatcgggagcggaagtgaagaagcccggagagtcacttagaatctcatgcaaggggtcgggcttcaacatcgaggattactacatccattgggtccgccagatgcctggtaaaggactggaatggatggggaggattgacccggaaaacgacgaaactaagtacggaccgatctttcaagggcacgtgactatctccgctgatacctcaatcaatactgtctacctccagtggtcctcgctgaaagcaagcgacaccgcgatgtactactgcgccttccggggaggagtgtactggggccaaggcaccacggtcacggtcagctcc

SEQ ID NO: 1489 - DNA, 834 bp, Artificial Sequence
  source: /note="Description of Artificial Sequence: Synthetic polynucleotide"
atggccctccctgtcaccgccctgctgcttccgctggctcttctgctccacgccgctcggcccgacgtggtgatgacccaatcgccagattccctggcagtgtccctgggcgaacgcgccactattaactgcaaatcgtcacagtccttgcttgattccgacggaaagacctacctcaattggctccagcagaagccaggacaaccgccaaagagactgatctccctggtgtcaaagctggactcgggagtgcctgatcggttctcgggtagcgggagcggcaccgacttcactctgaccatctcgtcactccaggctgaggacgtggccgtgtattactgttggcagggtactcactttccgggcactttcggaggcggcaccaaggtggagattaaaggaggaggcggaagcggaggtggaggatcgggaggtggtgggagcggcggaggagggagcgagatccagctcgtccaatcgggagcggaagtgaagaagcccggagagtcacttagaatctcatgcaaggggtcgggcttcaacatcgaggattactacatccattgggtccgccagatgcctggtaaaggactggaatggatggggaggattgacccggaaaacgacgaaactaagtacggaccgatctttcaagggcacgtgactatctccgctgatacctcaatcaatactgtctacctccagtggtcctcgctgaaagcaagcgacaccgcgatgtactactgcgccttccggggaggagtgtactggggccaaggcaccacggtcacggtcagctccggctcccatcaccaccaccatcaccatcatcac

SEQ ID NO: 1490 - protein, 278 aa, Artificial Sequence
  source: /note="Description of Artificial Sequence: Synthetic polypeptide"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGSHHHHHHHHH

SEQ ID NO: 1491 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgacgtggtgatgactcagtcgcctgactcgctggctgtgtcccttggagagcgggccactatcaattgcaagtcatcccagtcgctgctggattccgacgggaaaacctacctcaattggctgcagcaaaaaccgggacagcctccaaagcggctcatcagcctggtgtccaagttggacagcggcgtgccagaccgcttctccggttcgggaagcggtactgatttcacgctgaccatctcatccctccaagcggaggatgtggcagtctactactgttggcagggcacgcattttccgggcacttttggaggagggaccaaggtcgaaatcaagggaggaggtggctcgggcggaggaggctcgggaggaggaggatcaggaggcggtggaagcgagattcaactggtccagagcggcgcagaagtcaagaagccgggtgaatcgctcagaatctcgtgcaaaggatcgggattcaacatcgaggactactacattcactgggtcagacaaatgccgggcaaagggctggaatggatggggaggatcgaccccgaaaacgatgaaaccaagtacggaccaatcttccaagggcacgtgaccatttcggcggacacctcaatcaacactgtgtacctccagtggagctcacttaaggccagcgataccgccatgtactattgcgctttccgcggaggggtgtactggggacagggcactactgtgaccgtgtcatccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1492 - protein, 490 aa, Artificial Sequence
  source: /note="Description of Artificial Sequence: Synthetic polypeptide"
MALPVTALLLPLALLLHAARPDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGGSGGGGSGGGGSGGGGSEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1493 - protein, 246 aa, Artificial Sequence
  source: /note="Description of Artificial Sequence: Synthetic polypeptide"
DVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSS

SEQ ID NO: 1494 - DNA, 738 bp, Artificial Sequence
  source: /note="Description of Artificial Sequence: Synthetic polynucleotide"
gatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcg

SEQ ID NO: 1495 - DNA, 831 bp, Artificial Sequence
  source: /note="Description of Artificial Sequence: Synthetic polynucleotide"
atggccctccctgtcaccgccctgctgcttccgctggctcttctgctccacgccgctcggcccgatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcggggtcccaccatcatcaccaccaccatcac

SEQ ID NO: 1496 - protein, 277 aa, Artificial Sequence
  source: /note="Description of Artificial Sequence: Synthetic polypeptide"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSGSHHHHHHHH

SEQ ID NO: 1497 - DNA, 1470 bp, Artificial Sequence
  source: /note="Description of Artificial Sequence: Synthetic polynucleotide"
atggccctccctgtcaccgccctgctgcttccgctggctcttctgctccacgccgctcggcccgatgtggtcatgacgcagtcaccactgtccctccccgtgacccttggacagccagcgtcgattagctgcaagtcatcccaatccctgctcgattcggatggaaagacctatctcaactggctgcagcaaagacccggtcagagccctaggagactcatctcgttggtgtcaaagctggacagcggagtgccggaccggttttccggttcgggatcggggacggacttcactctgaagatttcacgggtggaagctgaggatgtgggagtgtactactgctggcagggaacccatttccctggcacttttggcggaggaactaaggtcgaaatcaagggaggaggtggctcgggaggaggcggatcgggcggaggcgggagcggcggaggagggtccgaaatccaacttgtccagtcaggagccgaagtgaagaaaccgggagccaccgtcaaaatcagctgtaagggatcgggattcaatatcgaggactactacatccactgggtgcagcaagctccgggcaaaggactggagtggatggggcgcatcgacccagagaacgacgaaaccaaatacggcccgatcttccaagggcgggtgaccatcaccgcggacacctcaactaacactgtgtacatggagctgagctccctgcgctccgaagatactgcagtctactactgcgccttccgcggtggtgtgtactggggacagggcaccactgtgactgtcagctcgaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1498 - protein, 490 aa, Artificial Sequence
  source: /note="Description of Artificial Sequence: Synthetic polypeptide"
MALPVTALLLPLALLLHAARPDVVMTQSPLSLPVTLGQPASISCKSSQSLLDSDGKTYLNWLQQRPGQSPRRLISLVSKLDSGVPDRFSGSGSGTDFTLKISRVEAEDVGVYYCWQGTHFPGTFGGGTKVEIKGGGGSGGGGSGGGGSGGGGSEIQLVQSGAEVKKPGATVKISCKGSGFNIEDYYIHWVQQAPGKGLEWMGRIDPENDETKYGPIFQGRVTITADTSTNTVYMELSSLRSEDTAVYYCAFRGGVYWGQGTTVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1499 - protein, 243 aa, Artificial Sequence
  source: /note="Description of Artificial Sequence: Synthetic polypeptide"
EIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIK

SEQ ID NO: 1500 - DNA, 729 bp, Artificial Sequence
  source: /note="Description of Artificial Sequence: Synthetic polynucleotide"
gagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaag

SEQ ID NO: 1501 - DNA, 822 bp, Artificial Sequence
  source: /note="Description of Artificial Sequence: Synthetic polynucleotide"
atggccctccctgtcaccgccctgctgcttccgctggctcttctgctccacgccgctcggcccgagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaagggtagccatcaccatcaccaccaccatcat

SEQ ID NO: 1502 - protein, 274 aa, Artificial Sequence
  source: /note="Description of Artificial Sequence: Synthetic polypeptide"
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKGSHHHHHHHH

SEQ ID NO: 1503 - DNA, 1461 bp, Artificial Sequence
  source: /note="Description of Artificial Sequence: Synthetic polynucleotide"
atggccctccctgtcaccgccctgctgcttccgctggctcttctgctccacgccgctcggcccgagatccagctccaacagagcggagccgaactggtcaaaccgggagcgtcggtgaagttgtcatgcactggatcgggcttcaacatcgaggattactacatccactgggtcaagcaacgcaccgagcaggggctggaatggatcggacggatcgaccccgaaaacgatgaaaccaagtacgggcctatcttccaaggacgggccaccattacggctgacacgtcaagcaataccgtctacctccagctttccagcctgacctccgaggacactgccgtgtactactgcgccttcagaggaggcgtgtactggggaccaggaaccactttgaccgtgtccagcggaggcggtggatcaggaggaggaggctcaggcggtggcggctcgcacatggacgtggtcatgactcagtccccgctgaccctgtcggtggcaattggacagagcgcatccatctcgtgcaagagctcacagtcgctgctggattccgacggaaagacttatctgaactggctgctccaaagaccagggcaatcaccgaaacgccttatctccctggtgtcgaaactcgactcgggtgtgccggatcggtttaccggtagcgggtccggcacggacttcactctccgcatttcgagggtggaagcggaggatctcgggatctactactgttggcagggaacccacttccctgggacttttggaggcggaactaagctggaaatcaagaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1504 - protein, 487 aa, Artificial Sequence
  source: /note="Description of Artificial Sequence: Synthetic polypeptide"
MALPVTALLLPLALLLHAARPEIQLQQSGAELVKPGASVKLSCTGSGFNIEDYYIHWVKQRTEQGLEWIGRIDPENDETKYGPIFQGRATITADTSSNTVYLQLSSLTSEDTAVYYCAFRGGVYWGPGTTLTVSSGGGGSGGGGSGGGGSHMDVVMTQSPLTLSVAIGQSASISCKSSQSLLDSDGKTYLNWLLQRPGQSPKRLISLVSKLDSGVPDRFTGSGSGTDFTLRISRVEAEDLGIYYCWQGTHFPGTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1505 - protein, 240 aa, Artificial Sequence
  source: /note="Description of Artificial Sequence: Synthetic polypeptide"
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 1506 - DNA, 720 bp, Artificial Sequence
  source: /note="Description of Artificial Sequence: Synthetic polynucleotide"
gatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctcc

SEQ ID NO: 1507 - DNA, 807 bp, Artificial Sequence
  source: /note="Description of Artificial Sequence: Synthetic polynucleotide"
atggccctccctgtcaccgccctgctgcttccgctggctcttctgctccacgccgctcggcccgatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctcccatcaccatcaccaccaccatcac

SEQ ID NO: 1508 - protein, 269 aa, Artificial Sequence
  source: /note="Description of Artificial Sequence: Synthetic polypeptide"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSHHHHHHHH

SEQ ID NO: 1509 - DNA, 1452 bp, Artificial Sequence
  source: /note="Description of Artificial Sequence: Synthetic polynucleotide"
atggccctccctgtcaccgccctgctgcttccgctggctcttctgctccacgccgctcggcccgatatccaaatgactcagagcccttcatccctgagcgccagcgtcggagacagggtgaccatcacgtgccgggcatcccaaggcattagaaataacttggcgtggtatcagcaaaaaccaggaaaggccccgaagcgcctgatctacgcggcctccaaccttcagtcaggagtgccctcgcgcttcaccgggagcggtagcggaactgagtttacccttatcgtgtcgtccctgcagccagaggacttcgcgacctactactgcctccagcatcactcgtacccgttgacttcgggaggcggaaccaaggtcgaaatcaaacgcactggctcgacgtcagggtccggtaaaccgggatcgggagaaggatcggaagtccaagtgctggagagcggaggcggactcgtgcaacctggcgggtcgctgcggctcagctgtgccgcgtcgggttttactttcagctcgtacgctatgtcatgggtgcggcaggctccgggaaaggggctggaatgggtgtccgctatttccggctcgggtggaagcaccaattacgccgactccgtgaagggacgcttcaccatctcacgggataactccaagaatactctgtacctccagatgaactcgctgagagccgaggacaccgcagtgtactactgcgcagggtcaagcggctggtccgaatactggggacagggcaccctcgtcactgtcagctccaccactaccccagcaccgaggccacccaccccggctcctaccatcgcctcccagcctctgtccctgcgtccggaggcatgtagacccgcagctggtggggccgtgcatacccggggtcttgacttcgcctgcgatatctacatttgggcccctctggctggtacttgcggggtcctgctgctttcactcgtgatcactctttactgtaagcgcggtcggaagaagctgctgtacatctttaagcaacccttcatgaggcctgtgcagactactcaagaggaggacggctgttcatgccggttcccagaggaggaggaaggcggctgcgaactgcgcgtgaaattcagccgcagcgcagatgctccagcctacaagcaggggcagaaccagctctacaacgaactcaatcttggtcggagagaggagtacgacgtgctggacaagcggagaggacgggacccagaaatgggcgggaagccgcgcagaaagaatccccaagagggcctgtacaacgagctccaaaaggataagatggcagaagcctatagcgagattggtatgaaaggggaacgcagaagaggcaaaggccacgacggactgtaccagggactcagcaccgccaccaaggacacctatgacgctcttcacatgcaggccctgccgcctcgg

SEQ ID NO: 1510 - protein, 484 aa, Artificial Sequence
  source: /note="Description of Artificial Sequence: Synthetic polypeptide"
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIKRTGSTSGSGKPGSGEGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1511 - protein, 244 aa, Artificial Sequence
  source: /note="Description of Artificial Sequence: Synthetic polypeptide"
QVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIK

SEQ ID NO: 1512 - protein, 488 aa, Artificial Sequence
  source: /note="Description of Artificial Sequence: Synthetic polypeptide"
MALPVTALLLPLALLLHAARPQVQLQQSGAEVKKPGASVKVSCKASGYTFTGYYMHWVRQAPGQGLEWMGRINPNSGGTNYAQKFQGRVTMTRDTSISTAYMELSRLRSEDTAVYYCARGRYYGMDVWGQGTMVTVSSGGGGSGGGGSGGGGSGGGGSEIVLTQSPATLSLSPGERATISCRASQSVSSNFAWYQQRPGQAPRLLIYDASNRATGIPPRFSGSGSGTDFTLTISSLEPEDFAAYYCHQRSNWLYTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1513 - protein, 253 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIK

SEQ ID NO: 1514 - protein, 497 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDLRRTVVTPRAYYGMDVWGQGTTVTVSSGGGGSGGGGSGGGGSGGGGSDIQLTQSPSTLSASVGDRVTITCQASQDISNSLNWYQQKAGKAPKLLIYDASTLETGVPSRFSGSGSGTDFSFTISSLQPEDIATYYCQQHDNLPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1515 - protein, 246 aa, Artificial Sequence
  source: /note="Description of Artificial Sequence: Synthetic polypeptide"
QVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIK

SEQ ID NO: 1516 - protein, 490 aa, Artificial Sequence
  source: /note="Description of Artificial Sequence: Synthetic polypeptide"
MALPVTALLLPLALLLHAARPQVQLVQSGAEVKKPGAPVKVSCKASGYTFTGYYMHWVRQAPGQGLEWMGWINPNSGGTNYAQKFQGRVTMTRDTSISTAYMELSRLRSDDTAVYYCARGEWDGSYYYDYWGQGTLVTVSSGGGGSGGGGSGGGGSGGGGSDIVLTQTPSSLSASVGDRVTITCRASQSINTYLNWYQHKPGKAPKLLIYAASSLQSGVPSRFSGSGSGTDFTLTISSLQPEDFATYYCQQSFSPLTFGGGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1517 - protein, 242 aa, Artificial Sequence
  source: /note="Description of Artificial Sequence: Synthetic polypeptide"
QVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIK

SEQ ID NO: 1518 - protein, 486 aa, Artificial Sequence
  source: /note="Description of Artificial Sequence: Synthetic polypeptide"
MALPVTALLLPLALLLHAARPQVQLVESGGGLVQPGGSLRLSCAASGFTFSSYWMHWVRQVPGKGLVWVSRINTDGSTTTYADSVEGRFTISRDNAKNTLYLQMNSLRDDDTAVYYCVGGHWAVWGQGTTVTVSSGGGGSGGGGSGGGGSGGGGSDIQMTQSPSTLSASVGDRVTITCRASQSISDRLAWYQQKPGKAPKLLIYKASSLESGVPSRFSGSGSGTEFTLTISSLQPDDFAVYYCQQYGHLPMYTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1519 - protein, 241 aa, Artificial Sequence
  source: /note="Description of Artificial Sequence: Synthetic polypeptide"
QVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 1520 - protein, 485 aa, Artificial Sequence
  source: /note="Description of Artificial Sequence: Synthetic polypeptide"
MALPVTALLLPLALLLHAARPQVQLVQSGAEVEKPGASVKVSCKASGYTFTDYYMHWVRQAPGQGLEWMGWINPNSGGTNYAQKFQGRVTMTRDTSISTAYMELSRLRSDDTAVYYCASGWDFDYWGQGTLVTVSSGGGGSGGGGSGGGGSGGGGSDIVMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1521 - protein, 253 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIK

SEQ ID NO: 1522 - protein, 497 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARYRLIAVAGDYYYYGMDVWGQGTMVTVSSGGGGSGGGGSGGGGSGGGGSDIQMTQSPSSVSASVGDRVTITCRASQGVGRWLAWYQQKPGTAPKLLIYAASTLQSGVPSRFSGSGSGTDFTLTINNLQPEDFATYYCQQANSFPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1523 - protein, 250 aa, Artificial Sequence
  source: /note="Description of Artificial Sequence: Synthetic polypeptide"
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIK

SEQ ID NO: 1524 - protein, 494 aa, Artificial Sequence
  source: /note="Description of Artificial Sequence: Synthetic polypeptide"
MALPVTALLLPLALLLHAARPQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARWKVSSSSPAFDYWGQGTLVTVSSGGGGSGGGGSGGGGSGGGGSEIVLTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1525 - protein, 246 aa, Artificial Sequence
  source: /note="Description of Artificial Sequence: Synthetic polypeptide"
QVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIK

SEQ ID NO: 1526 - protein, 490 aa, Artificial Sequence
  source: /note="Description of Artificial Sequence: Synthetic polypeptide"
MALPVTALLLPLALLLHAARPQVQLQQSGAEVKKPGASVKVSCKTSGYPFTGYSLHWVRQAPGQGLEWMGWINPNSGGTNYAQKFQGRVTMTRDTSISTAYMELSRLRSDDTAVYYCARDHYGGNSLFYWGQGTLVTVSSGGGGSGGGGSGGGGSGGGGSDIQLTQSPSSISASVGDTVSITCRASQDSGTWLAWYQQKPGKAPNLLMYDASTLEDGVPSRFSGSASGTEFTLTVNRLQPEDSATYYCQQYNSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1527 - protein, 248 aa, Artificial Sequence
  source: /note="Description of Artificial Sequence: Synthetic polypeptide"
QVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIK

SEQ ID NO: 1528 - protein, 492 aa, Artificial Sequence
  source: /note="Description of Artificial Sequence: Synthetic polypeptide"
MALPVTALLLPLALLLHAARPQVQLVQSGAEVKKPGASVEVSCKASGYTFTSYYMHWVRQAPGQGLEWMGIINPSGGSTGYAQKFQGRVTMTRDTSTSTVHMELSSLRSEDTAVYYCARGGYSSSSDAFDIWGQGTMVTVSSGGGGSGGGGSGGGGSGGGGSDIQMTQSPPSLSASVGDRVTITCRASQDISSALAWYQQKPGTPPKLLIYDASSLESGVPSRFSGSGSGTDFTLTISSLQPEDFATYYCQQFSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1529 - protein, 255 aa, Artificial Sequence
  source: /note="Description of Artificial Sequence: Synthetic polypeptide"
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEIN

SEQ ID NO: 1530 - protein, 499 aa, Artificial Sequence
  source: /note="Description of Artificial Sequence: Synthetic polypeptide"
MALPVTALLLPLALLLHAARPQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVAGGIYYYYGMDVWGQGTTITVSSGGGGSGGGGSGGGGSGGGGSDIVMTQTPDSLAVSLGERATISCKSSHSVLYNRNNKNYLAWYQQKPGQPPKLLFYWASTRKSGVPDRFSGSGSGTDFTLTISSLQPEDFATYFCQQTQTFPLTFGQGTRLEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1531 - protein, 241 aa, Artificial Sequence
  source: /note="Description of Artificial Sequence: Synthetic polypeptide"
QVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIK

SEQ ID NO: 1532 - protein, 485 aa, Artificial Sequence
  source: /note="Description of Artificial Sequence: Synthetic polypeptide"
MALPVTALLLPLALLLHAARPQVQLQQSGAEVKKPGASVKVSCKASGYTFTGYYMHWVRQAPGQGLEWMGWINPNSGGTNYAQNFQGRVTMTRDTSISTAYMELRRLRSDDTAVYYCASGWDFDYWGQGTLVTVSSGGGGSGGGGSGGGGSGGGGSDIRMTQSPSSLSASVGDRVTITCRASQSIRYYLSWYQQKPGKAPKLLIYTASILQNGVPSRFSGSGSGTDFTLTISSLQPEDFATYYCLQTYTTPDFGPGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1533 - protein, 246 aa, Artificial Sequence
  source: /note="Description of Artificial Sequence: Synthetic polypeptide"
QVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIK

SEQ ID NO: 1534 - protein, 490 aa, Artificial Sequence
  source: /note="Description of Artificial Sequence: Synthetic polypeptide"
MALPVTALLLPLALLLHAARPQVQLVQSGAEVKKPGASVKVSCKASGYTFTGYYMHWVRQAPGQGLEWMGRINPNSGGTNYAQKFQGRVTMTTDTSTSTAYMELRSLRSDDTAVYYCARTTTSYAFDIWGQGTMVTVSSGGGGSGGGGSGGGGSGGGGSDIQLTQSPSTLSASVGDRVTITCRASQSISTWLAWYQQKPGKAPNLLIYKASTLESGVPSRFSGSGSGTEFTLTISSLQPDDFATYYCQQYNTYSPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1535 - protein, 249 aa, Artificial Sequence
  source: /note="Description of Artificial Sequence: Synthetic polypeptide"
QVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIK

SEQ ID NO: 1536 - protein, 493 aa, Artificial Sequence
  source: /note="Description of Artificial Sequence: Synthetic polypeptide"
MALPVTALLLPLALLLHAARPQVQLVQSGGGLVKPGGSLRLSCEASGFIFSDYYMGWIRQAPGKGLEWVSYIGRSGSSMYYADSVKGRFTFSRDNAKNSLYLQMNSLRAEDTAVYYCAASPVVAATEDFQHWGQGTLVTVSSGGGGSGGGGSGGGGSGGGGSDIVMTQTPATLSLSPGERATLSCRASQSVTSNYLAWYQQKPGQAPRLLLFGASTRATGIPDRFSGSGSGTDFTLTINRLEPEDFAMYYCQQYGSAPVTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1537 - protein, 249 aa, Artificial Sequence
  source: /note="Description of Artificial Sequence: Synthetic polypeptide"
QVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 1538 - protein, 493 aa, Artificial Sequence
  source: /note="Description of Artificial Sequence: Synthetic polypeptide"
MALPVTALLLPLALLLHAARPQVQLVQSGAEVRAPGASVKISCKASGFTFRGYYIHWVRQAPGQGLEWMGIINPSGGSRAYAQKFQGRVTMTRDTSTSTVYMELSSLRSDDTAMYYCARTASCGGDCYYLDYWGQGTLVTVSSGGGGSGGGGSGGGGSGGGGSDIQMTQSPPTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1539 - protein, 244 aa, Artificial Sequence
  source: /note="Description of Artificial Sequence: Synthetic polypeptide"
QVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVL

SEQ ID NO: 1540 - protein, 488 aa, Artificial Sequence
  source: /note="Description of Artificial Sequence: Synthetic polypeptide"
MALPVTALLLPLALLLHAARPQVQLVQSGGGLVQPGRSLRLSCAASGFTFDDYAMHWVRQAPGKGLEWVSGISWNSGSIGYADSVKGRFTISRDNAKNSLYLQMNSLRAEDTAVYYCAKDGSSSWSWGYFDYWGQGTLVTVSSGGGGSGGGGSGGGGSSSELTQDPAVSVALGQTVRTTCQGDALRSYYASWYQQKPGQAPMLVIYGKNNRPSGIPDRFSGSDSGDTASLTITGAQAEDEADYYCNSRDSSGYPVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1541 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVL

SEQ ID NO: 1542 - protein, 490 aa, Artificial Sequence
  source: /note="Description of Artificial Sequence: Synthetic polypeptide"
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQEPAVSVALGQTVRITCQGDSLRSYYASWYQQKPGQAPVLVIFGRSRRPSGIPDRFSGSSSGNTASLIITGAQAEDEADYYCNSRDNTANHYVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1543 - protein, 246 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVL

SEQ ID NO: 1544 - protein, 490 aa, Artificial Sequence
  source: /note="Description of Artificial Sequence: Synthetic polypeptide"
MALPVTALLLPLALLLHAARPEVQLVESGGGLVQPGRSLRLSCAASGFTFDDYAMHWVRQAPGKGLEWVSGISWNSGSTGYADSVKGRFTISRDNAKNSLYLQMNSLRAEDTALYYCAKDSSSWYGGGSAFDIWGQGTMVTVSSGGGGSGGGGSGGGGSSSELTQDPAVSVALGQTVRITCQGDSLRSYYASWYQQKPGQAPVLVIYGKNNRPSGIPDRFSGSSSGNTASLTITGAQAEDEADYYCNSRGSSGNHYVFGTGTKVTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1545 - protein, 251 aa, Artificial Sequence
  source: /note="Description of Artificial Sequence: Synthetic polypeptide"
QVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIK

SEQ ID NO: 1546 - protein, 495 aa, Artificial Sequence
  source: /note="Description of Artificial Sequence: Synthetic polypeptide"
MALPVTALLLPLALLLHAARPQVQLVQSGGGLVQPGGSLRLSCAASGFTFSSYWMHWVRQAPGKGLVWVSRINSDGSSTSYADSVKGRFTISRDNAKNTLYLQMNSLRAEDTAVYYCVRTGWVGSYYYYMDVWGKGTTVTVSSGGGGSGGGGSGGGGSGGGGSEIVLTQSPGTLSLSPGERATLSCRASQSVSSNYLAWYQQKPGQPPRLLIYDVSTRATGIPARFSGGGSGTDFTLTISSLEPEDFAVYYCQQRSNWPPWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1547 - protein, 250 aa, Artificial Sequence
  source: /note="Description of Artificial Sequence: Synthetic polypeptide"
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIK

SEQ ID NO: 1548 - protein, 494 aa, Artificial Sequence
  source: /note="Description of Artificial Sequence: Synthetic polypeptide"
MALPVTALLLPLALLLHAARPQVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGYSRYYYYGMDVWGQGTTVTVSSGGGGSGGGGSGGGGSGGGGSEIVMTQSPATLSLSPGERAILSCRASQSVYTKYLGWYQQKPGQAPRLLIYDASTRATGIPDRFSGSGSGTDFTLTINRLEPEDFAVYYCQHYGGSPLITFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1549 - protein, 249 aa, Artificial Sequence
  source: /note="Description of Artificial Sequence: Synthetic polypeptide"
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIK

SEQ ID NO: 1550 - protein, 493 aa, Artificial Sequence
  source: /note="Description of Artificial Sequence: Synthetic polypeptide"
MALPVTALLLPLALLLHAARPQVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKREAAAGHDWYFDLWGRGTLVTVSSGGGGSGGGGSGGGGSGGGGSDIRVTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1551 - protein, 247 aa, Artificial Sequence
  source: /note="Description of Artificial Sequence: Synthetic polypeptide"
QVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIK

SEQ ID NO: 1552 - protein, 491 aa, Artificial Sequence
  source: /note="Description of Artificial Sequence: Synthetic polypeptide"
MALPVTALLLPLALLLHAARPQVQLVQSWAEVKKPGASVKVSCKASGYTFTSYYMHWVRQAPGQGLEWMGIINPSGGSTSYAQKFQGRVTMTRDTSTSTVYMELSNLRSEDTAVYYCARSPRVTTGYFDYWGQGTLVTVSSGGGGSGGGGSGGGGSGGGGSDIQLTQSPSTLSASVGDRVTITCRASQSISSWLAWYQQKPGKAPKLLIYKASSLESGVPSRFSGSGSGTEFTLTISSLQPDDFATYYCQQYSSYPLTFGGGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1553 - protein, 253 aa, Artificial Sequence
  source: /note="Description of Artificial Sequence: Synthetic polypeptide"
QVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIK

SEQ ID NO: 1554 - protein, 497 aa, Artificial Sequence
  source: /note="Description of Artificial Sequence: Synthetic polypeptide"
MALPVTALLLPLALLLHAARPQVQLVQSGAEVRRPGASVKISCRASGDTSTRHYIHWLRQAPGQGPEWMGVINPTTGPATGSPAYAQMLQGRVTMTRDTSTRTVYMELRSLRFEDTAVYYCARSVVGRSAPYYFDYWGQGTLVTVSSGGGGSGGGGSGGGGSGGGGSDIQMTQSPSSLSASVGDRVTITCRASQGISDYSAWYQQKPGKAPKLLIYAASTLQSGVPSRFSGSGSGTDFTLTISYLQSEDFATYYCQQYYSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1555 - protein, 249 aa, Artificial Sequence
  source: /note="Description of Artificial Sequence: Synthetic polypeptide"
QVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIK

SEQ ID NO: 1556 - protein, 493 aa, Artificial Sequence
  source: /note="Description of Artificial Sequence: Synthetic polypeptide"
MALPVTALLLPLALLLHAARPQVQLQQSGAEVKKPGASVKVSCKASGYTFTNYYMHWVRQAPGQGLEWMGIINPSGGYTTYAQKFQGRLTMTRDTSTSTVYMELSSLRSEDTAVYYCARIRSCGGDCYYFDNWGQGTLVTVSSGGGGSGGGGSGGGGSGGGGSDIQLTQSPSTLSASVGDRVTITCRASENVNIWLAWYQQKPGKAPKLLIYKSSSLASGVPSRFSGSGSGAEFTLTISSLQPDDFATYYCQQYQSYPLTFGGGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1557 - protein, 246 aa, Artificial Sequence
  source: /note="Description of Artificial Sequence: Synthetic polypeptide"
QITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIK

SEQ ID NO: 1558 - protein, 490 aa, Artificial Sequence
  source: /note="Description of Artificial Sequence: Synthetic polypeptide"
MALPVTALLLPLALLLHAARPQITLKESGPALVKPTQTLTLTCTFSGFSLSTAGVHVGWIRQPPGKALEWLALISWADDKRYRPSLRSRLDITRVTSKDQVVLSMTNMQPEDTATYYCALQGFDGYEANWGPGTLVTVSSGGGGSGGGGSGGGGSGGGGSDIVMTQSPSSLSASAGDRVTITCRASRGISSALAWYQQKPGKPPKLLIYDASSLESGVPSRFSGSGSGTDFTLTIDSLEPEDFATYYCQQSYSTPWTFGQGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1559 - protein, 239 aa, Artificial Sequence
  source: /note="Description of Artificial Sequence: Synthetic polypeptide"
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEI

SEQ ID NO: 1560 - protein, 383 aa, Artificial Sequence
  source: /note="Description of Artificial Sequence: Synthetic polypeptide"
MALPVTALLLPLALLLHAARPQVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSSGGGGSGGGGSGGGGSDIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEITTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPA

What is claimed is:
1. A fusion polypeptide comprising:
(i) a CRBN (cereblon)-binding polypeptide, and
(ii) a chimeric antigen receptor (CAR) that comprises, in a N-terminal to C-terminal direction, an antigen binding domain, a transmembrane domain, and one or more intracellular signaling domains, wherein the CRBN-binding polypeptide comprises the amino acid sequence of SEQ ID NO: 3 or SEQ ID NO: 1.

2. The fusion polypeptide of claim 1, wherein the CRBN-binding polypeptide is fused to the CAR.

3. The fusion polypeptide of claim 1, wherein the association of CRBN with the CRBN-binding polypeptide or the fusion polypeptide in the absence of lenalidomide or pomalidomide, or a pharmaceutically acceptable salt thereof, is no more than 20% of the association of CRBN with the CRBN-binding polypeptide or the fusion polypeptide in the presence of lenalidomide or pomalidomide, or a pharmaceutically acceptable salt thereof.

4. The fusion polypeptide of claim 1, wherein the degradation or ubiquitination of the fusion polypeptide in the absence of lenalidomide or pomalidomide, or a pharmaceutically acceptable salt thereof, is no more than 70% of the degradation or ubiquitination of the fusion polypeptide in the presence of lenalidomide or pomalidomide, or a pharmaceutically acceptable salt thereof.

5. The fusion polypeptide of claim 1, wherein the fusion polypeptide further comprises a degradation domain, wherein the degradation domain is separated from the CRBN-binding polypeptide and the CAR by a heterologous protease cleavage site.

6. The fusion polypeptide of claim 5, wherein the fusion polypeptide comprises, from N-terminus to C-terminus:
   i) the degradation domain, the heterologous protease cleavage site, the CAR, and the CRBN-binding polypeptide;
   ii) the degradation domain, the heterologous protease cleavage site, the CRBN-binding polypeptide, and the CAR;
   iii) the CRBN-binding polypeptide, the CAR, the heterologous protease cleavage site, and the degradation domain; or
   iv) the CAR, the CRBN-binding polypeptide, the heterologous protease cleavage site, and the degradation domain.

7. A composition comprising the fusion polypeptide of claim 1, and a pharmaceutically acceptable carrier, excipient or stabilizer.

8. The fusion polypeptide of claim 1, wherein the association of CRBN with the CRBN-binding polypeptide or the fusion polypeptide in the absence of lenalidomide or pomalidomide, or a pharmaceutically acceptable salt thereof, is no more than 10% of the association of CRBN with the CRBN-binding polypeptide or the fusion polypeptide in the presence of lenalidomide or pomalidomide, or a pharmaceutically acceptable salt thereof.

9. The fusion polypeptide of claim 1, wherein the association of CRBN with the CRBN-binding polypeptide or the fusion polypeptide in the absence of lenalidomide or pomalidomide, or a pharmaceutically acceptable salt thereof, is no more than 5% of the association of CRBN with the CRBN-binding polypeptide or the fusion polypeptide in the presence of lenalidomide or pomalidomide, or a pharmaceutically acceptable salt thereof.

10. The fusion polypeptide of claim 1, wherein the association of CRBN with the CRBN-binding polypeptide or the fusion polypeptide in the absence of lenalidomide or pomalidomide, or a pharmaceutically acceptable salt thereof, is no more than 1% of the association of CRBN with the CRBN-binding polypeptide or the fusion polypeptide in the presence of lenalidomide or pomalidomide, or a pharmaceutically acceptable salt thereof.

11. The fusion polypeptide of claim 1, wherein the degradation or ubiquitination of the fusion polypeptide in the absence of lenalidomide or pomalidomide, or a pharmaceutically acceptable salt thereof, is no more than 50% of the degradation or ubiquitination of the fusion polypeptide in the presence of lenalidomide or pomalidomide, or a pharmaceutically acceptable salt thereof.

12. The fusion polypeptide of claim 1, wherein the degradation or ubiquitination of the fusion polypeptide in the absence of lenalidomide or pomalidomide, or a pharmaceutically acceptable salt thereof, is no more than 10% of the degradation or ubiquitination of the fusion polypeptide in the presence of lenalidomide or pomalidomide, or a pharmaceutically acceptable salt thereof.

13. The fusion polypeptide of claim 1, wherein the degradation or ubiquitination of the fusion polypeptide in the absence of lenalidomide or pomalidomide, or a pharmaceutically acceptable salt thereof, is no more than 1% of the degradation or ubiquitination of the fusion polypeptide in the presence of lenalidomide or pomalidomide, or a pharmaceutically acceptable salt thereof.

14. The fusion polypeptide of claim 1, wherein the CRBN-binding polypeptide comprises the amino acid sequence of SEQ ID NO: 1.

15. The fusion polypeptide of claim 1, wherein the CRBN-binding polypeptide consists of the amino acid sequence of SEQ ID NO: 1 or 3.

16. The fusion polypeptide of claim 5, wherein the degradation domain is an estrogen receptor (ER) domain.

17. The fusion polypeptide of claim 5, wherein
   the degradation domain is an ER domain and comprises an amino acid sequence that is at least 90% identical to SEQ ID NO: 46 or 48.

18. The fusion polypeptide of claim 1, wherein the CRBN-binding polypeptide is linked to the CAR by a peptide bond.

19. The fusion polypeptide of claim 1, wherein the CRBN-binding polypeptide is linked to the CAR by a bond other than a peptide bond.

20. The fusion polypeptide of claim 1, wherein the CAR is linked directly to the CRBN-binding polypeptide.

21. The fusion polypeptide of claim 1, wherein the CAR is linked indirectly to the CRBN-binding polypeptide.

22. The fusion polypeptide of claim 1, wherein the CRBN-binding polypeptide is operatively linked to the CAR via a linker, a glycine serine linker, or a linker comprising the amino acid sequence of SEQ ID NO: 28.

23. The fusion polypeptide of claim 5, wherein the heterologous protease cleavage site is cleaved by a protease selected from the group consisting of furin, PCSK1, PCSK5, PCSK6, PCSK7, cathepsin B, Granzyme B, Factor XA, Enterokinase, genenase, sortase, precission protease, thrombin, TEV protease, and elastase 1.

24. The fusion polypeptide of claim 5, wherein the heterologous protease cleavage site comprises a sequence having a cleavage motif selected from the group consisting of Arg-X-Lys/Arg-Arg consensus motif (X can be any amino acid; SEQ ID NO: 52), Arg-X-X-X-Lys/Arg-Arg consensus motif (X can be any amino acid; SEQ ID NO: 53), Arg-Arg-X consensus motif (SEQ ID NO: 54), Ile-Glu-Pro-Asp-X consensus motif (SEQ ID NO: 55), Ile-Glu/Asp-Gly-Arg (SEQ ID NO: 56), Asp-Asp-Asp-Asp-Lys (SEQ ID NO: 57), Pro-Gly-Ala-Ala-His-Tyr (SEQ ID NO: 58), Leu-Pro-X-Thr-Gly/Ala consensus motif (SEQ ID NO: 59), Leu-Glu-Val-Phe-Gln-Gly-Pro (SEQ ID NO: 60), Leu-Val-Pro-Arg-Gly-Ser (SEQ ID NO: 61), Glu-Asn-Leu-Tyr-Phe-Gln-Gly (SEQ ID NO: 62), and [Ala-Gly-Ser-Val]X (X can be any amino acid; SEQ ID NO: 63).

25. The fusion polypeptide of claim 5, wherein the heterologous protease cleavage site is cleaved by furin.

26. The fusion polypeptide of claim 25, wherein the heterologous protease cleavage site comprises a furin cleavage site selected from the group consisting of RTKR (SEQ ID NO: 123); GTGAEDPRPSRKRRSLGDVG (SEQ ID NO: 125); GTGAEDPRPSRKRR (SEQ ID NO: 127); LQWLEQQVAKRRTKR (SEQ ID NO: 129); GTGAE- DPRPSRKRRSLGG (SEQ ID NO: 131); GTGAE-DPRPSRKRRSLG (SEQ ID NO: 133); SLNLTESHN-SRKKR (SEQ ID NO: 135); CKINGYPKRGRKRR (SEQ ID NO: 137); and SARNRQKR (SEQ ID NO: 34).

27. The fusion polypeptide of claim 5, wherein the heterologous protease cleavage site is cleaved by a mammalian extracellular protease selected from the group consisting of Factor XA, Enterokinase, genenase, sortase, precission protease, thrombin, TEV protease, and elastase 1.

28. The fusion polypeptide of claim 27, wherein the heterologous protease cleavage site comprises an amino acid sequence selected from the group consisting of Ile-Glu/Asp-Gly-Arg (SEQ ID NO: 56), Asp-Asp-Asp-Asp-Lys (SEQ ID NO: 57), Pro-Gly-Ala-Ala-His-Tyr (SEQ ID NO: 58), Leu-Pro-X-Thr-Gly/Ala consensus motif (SEQ ID NO: 59), Leu-Glu-Val-Phe-Gln-Gly-Pro (SEQ ID NO: 60), Leu-Val-Pro-Arg-Gly-Ser (SEQ ID NO: 61), Glu-Asn-Leu-Tyr-Phe-Gln-Gly (SEQ ID NO: 62), and [Ala-Gly-Ser-Val]-X (X can be any amino acid; SEQ ID NO: 63.

29. The fusion polypeptide of claim 5, wherein the degradation domain is an FKB protein (FKBP) domain.

30. The fusion polypeptide of claim 5, wherein the degradation domain is a dihydrofolate reductase (DHFR) domain.

31. The fusion polypeptide of claim 5, wherein the degradation domain is an FKBP domain and comprises an amino acid sequence that is at least 90% identical to SEQ ID NO: 50.

32. The fusion polypeptide of claim 5, wherein the degradation domain is a DHFR domain and comprises an amino acid sequence that is at least 90% identical to SEQ ID NO: 51.

33. The fusion polypeptide of claim 1, wherein the CRBN-binding polypeptide comprises the amino acid sequence of SEQ ID NO: 3.

* * * * *